United States Patent 9,567,581 (SELECTIVE REACTIVATION OF GENES ON THE INACTIVE X CHROMOSOME) - sequence listing, part 9

SEQ ID NO: 936 - DNA, 24900 bp, mus musculus
tccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgta

SEQ ID NO: 937 - DNA, 24900 bp, mus musculus; identical to SEQ ID NO: 936

SEQ ID NO: 938 - DNA, 330 bp, mus musculus
cggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccggg

SEQ ID NO: 939 - DNA, 80070 bp, mus musculus
ccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggtcagtgtggaccgtagcggtggcctgggggaccctggccagtgaggggtaggggaacctacagtagctcttgtggtgtttgggggtctctcatgcatgcgagagtgtagtgtagccatggcttggccccatatcctgcgaggtaggagtgggggttgtgccagttttgctggtggtgtgactgggggaggcagacacaataattttactactactactattaaatactaatatttaattagctcttgctgtgcagttgtatttagcactttacgtggattttctcagtcctcaacagtcctgtgaggtgggaactaaattcatccccgttttgcaaaaccaagaaactgaggtctggggagtttcaataactctcttgaggtcgaatcacctagcttgtaagtggctgaacgattttctcccatttaagacctgcagtactaattcctgaggtggctgctttgcctcactgatttcatatcctttgccctaaacagaacatcaggatacagatttctgtagtattgagggagcagtagtgttattccagtcctgctcttctctattttccgtagaaaatttagtaggtgaagaggaaggaggtagactcctttaagaaaaggttaaaaaaaaaaagaggagaagagggggtgagctcttaaactattcctgtgtgtgtgtgtgtgtgtgtgtgtgtgtgtgtgtgtatgaactgtgtttatatatatatatgaactgtgtttatatatatatatgaactgtgtttatatatatatatgaactgtgtttatatatatatatgaactgtgtttatatatatatatgaactgtgtttatatatatatatatgaactgtgtttatatatatatatatatgaactgtgtgtgtgtatatatatatatgaacttgcaggaaggtgtaggacatttattgtccaaagagaatccctttatgaagcaggggctgagtgccctgttgtatcctccttcctcctttcactaagagctcccaccacctgaatcttgtcttctgatgagccagttggtgggccagggtgcccctggtcctggcttggatttgtggctaaccaagtgagtggtgcatgaggctttccaatatcttcctggaagcctcatcatgattgatatattgtcgcctatgttgccatcattggtaaaatgtttgaaaattaggaattttgttgcctttcatccctggctagaataccacactgacctatcctccccctactaggtgttaataatttctgagttatccctgcaggatctgattcagaaagagaaagctgatgggagggagtaagtagagtggccccacagtagccatttttatatataaatctttcgaggagactctgaacatgctacaaattaatgttgggtagagatagctttatctgaacccaacattgtttatcctgaacaggccaagagaagagattggcatgaactgttgctttgccagttccagccagtaccagcaaaaacatacatgtatgttggagcatcagaggaaagcagctcctggtggagagtaagaaaaaggagtatttcagcttgtttctctttatttatttatgtatttatttattcattcaaaaaacacttgttgagtacctgcaatgaagtggactgctgtttcccaaaatctggtcccactaggcaagcctcctaaaagcaatatggttgtagatcactggaaaataaatatgatgacaatgtgttatatacattgactaggggttctgggtcctctcccatctccataccatctgtattctgcaattcagagttctttctgggattttattcttagtctttttcttgttcagtctccagaattccttaaggagcgcggtttttttatttttcctctgcctgattacctgctcttcctccctttctatactttatgctccatacttggtcattagcagaggtgaaattaccatgtagctgataaactttatgctttatggccttataactgtaggttgcttctggttctcattctaaataaataaccagtttcatactcagtcctgtatttgcaattttgctttcttatttcttagagaggatacccaagttatatataagttgtaggtcccacaaaacctgaatctgtccatagtcactcttaattattaatttatttccatttgggggaagtagagggcatttcttgcacagtagttcacacctctattccagaggccagcttcagtgacactggaaaaagcacttgacttcctctaatgccatctccatcagtcagatctgagtgattttaatactcaaactgaccagaaacattgctttctatctgtggtaccttcccagatggttcacagctaaaatgaaagtagttgcaagtgtggctcgtgttagatcctggacataaactgagtgtttcatgagcgggtgagaagcatcacttcccaagcattcttgtgaattcagaaacataccatttttgtgtgtgcttggcagtatcccatgaattacttaatagtccctgtggcagttttatatgcctttggatgttctttataacttttattaggacttgtacactttgataggttacccacacattcataatacatcaccaatccatagcatcagcagtgttatttctattatatagcacccagaagagtacatattctaagtgacattactcaaaattgatccatattagcaacattttttaaataactctctacacagagaatagcagcatctggatgtatctccttttttgtcattataaaacataaaatagactatgtcttacaaccacaaactctttttatctgcctaaccaccaattaaataattatatatagtatgttaatagttgagaggggaaataaccctgctgatttgttggtctagtggtatctttaaaatgctctggtccttaaccatcattcatcatctatcacccattcctttttgaaactcctttcatgttttcagcgatgctattggatcctgaatttttatcccatactgattgctgcttttccatccctttcattgtgctcatattcttgcaaacatctggttttgaaaggtttcactgttcatcactttggggctcttggtactctctccctctctttctcattctaggacttcagctgtcccttatctatagaaaactctcaagtctctgatttgaatcctcttccttccctgaactcctgtcccatagcttatctgctcctgggtatttcacgattgaacacttcaggttcaacatgtaccatagctactgtgctagccaatccagcttcttttcctcagttccttgactctgttcttagcaccaccatcccttctataatttttgacataatcttttcttttatcttctgcacccttttagcagatccttctcactcttctttggggctatctctcttctcctttctctatgatgacctccctccccccatcaccaggacagactcttttttaaaagtattttgtataaatgtaagggatacgactgcaattttgttacatggatagattgcatagtggtgaagtctgggcttttagtgtattcataacgtgaataatgtacgttgtacccattaggtaatttctcatcatcctccttcctcctgccccacacccttccagtcaccaatgtctattattccatacctctatgtctgtgtgtgtacattatttagctcccacttataagtgagaacatatggtattggactttctatttctgagttgtttcacttaagataatggtctccagttccatcaatgttgttgcaaaagctcttgacccctgaagctacctggttatgacccccttcccagtggccaccctttacaataatggctctccctttatgtccatcctgcattcagtgttctcccaaacttgatttttcttaaacacttctttcatcaccttgcccctctgctcagggccttcaatggtctcctattagcagcctcccaaacacctccctatcccgccccccatcatgacaagtagcatttcctactattttccaacatggatctgagctttagtctcaccgcctcgtgtcctcaggctacactacgtttatttagtcccttcatgccttttctgtttttatctttcttaacatggaagtgcttttctcttacatttatattctatctatccttcaatgcttggctgaagatcctttccttgatcactctggctcccattgatttttctctcctcttgtagagcttgtaatctgtacttaacaaacaatttacacttattttctatctcttatttcatgatttgattttaaggataatggctcagtcactgaattcagttgttagttcttactcatgagctgccacagatacaataaatgacagaaaactagcggtggaagatttttaaatctgccctcaactgagaatttctgaaatggttctctttagtagagaaaaaaaggaaacaagaaaaaagcccacctccaggggacaatgtatacttccttcatgagtctgtttggaatttgagtctttgggtcaaaggggttttaaaaggcaatctagtccaatcacctaagattttaatcttcttaacagcacctcgctagtgattagagccagatggctgtagctttgaacgcatttaaggataggaaatgctcggtctctcaaagcaactcattacaagtagaggtagctctggctccttgtcttgtttaagcatttcaagaacctctacctatatactaagcagtgactggggatcatggggaaagaaagagatatataatgatgagtaagtagcatccctgtacataaggtacttctatcttctggaagaagtaatcaagtgggtgaataattgacatgaatacagtgagataataattgatatgaatatagtgagataaatatcaatgtggtgagataaatattaatgttttgaatatgaacaaagtgcagggatcttgagagataagtagaattttaacaggtagagataagaggatggaaaaaaagacataccatacaggagagactagaggaacacagatacagtcatgagggtataagccagatatgagcagtgcttaatttcccaatggtgagagttccagggaatgaaaatagttgtttcctatgcctctaggtatgtgatcctggtagctattgagatgagcccagtgtgccacatctacccatgatttttgttcctgtgtgagctgtgaatggttagcgagcgcacagtgaaaatgccttagtcataacactggattgtcctgggtgaataaagtgtttcttcatttttttttattttgcaattaaattccaagtgtcacgtagaaagacctcttcatgtccaaatagtgtttaagcaatagaactcctctctatttttgtccatcagctgagctctgctgaaagaattgagaacactagctgcccagaattcagtgctgtataaaaccagcaggaatgaatttttcttatcttctgagagacagaaaagccattttgcaagagaaataactaatgttcagcattccgatgattgagtccacaacataccacaatttccctttttgctgaaatatatcacctgtaaaaattattctgctaggaccattttaggcattttaacccagaacttggcagcatgtactgtgtggttttgcagtgattaagaaaagcttccatttaagaaatgccacttatttttggtgtcttagttatttaaatactctgaggttcaatgtgggctgagcattaattttttgctgtttaggacacttctctgcccctaatttatattttatttttctaaaaaataaactagggtgtttttacttcataaactttttaaatactaaacaaagaatacaagaattacatttatttgtgttctgattttttttttttgaaatcttcatggttgaaggagcttttggatttatctggcattaaatgggaaattttagcatttagtcaatactaattgatttgaattgttacataatcctcagctattgtgaaaaatgtatttaacaatagatctaggtatagcataattgcatacattacagagaccaataatggagaaaaagaaacatggaacaccattattggtgaatattgggtcacaatctttgtgcagttatggcatagaaatattttaacctatgaaaaatcttgcagtatttgcattcaagtgtactcagaaagactaaggttgtattctagttttatattacatatagggtgcccagccctgtgatttagaaagtgtagacacccgataaatagttgttaaggaatatacttgtatgtaggagatgtatagatttcataatgatagggttttttttttcattgtaattagaacttcaaaaattgaatcaaaacattttctaaatgttgtgagcatttgagacaaattgattgttgggactgtttctcctcctttatcatgacaaatattttatatttttaccagcaatttgtattttccttcaaacaatctatttcttgttatgttgccatctgtcattgtgtattagggaaatttaaagtctttgaactatggttttgtcatccaagaagttggattaagttatatgtgatatatcttctggtatggatttttagtaattagtcaatttcatgaagatccgtctctttagctttctttcttggaccctcctcaacgtttttttcttctatgctttattctgggaagagtttgcattatctgtcatactgacattcttcacaaacttgaatcagggcctgggtctctccacaggtgctcattcacactttccccatggcttctctgagactttgtttaaaacccttttctagttgttgctaggcaaaagtaaacaaagcacactcaataacaatatttaattgattgactaagagtgttaagaacataaaaaacagatgataagatttaagagttgaagtaattatatattaaccatgtccaagggttatagaatggtggcctgtaagagcccaaagggactgaaacagaggctcagaggggtccagggaattaccaaatgccacaaaattcttagctgtttaacttgtccttggatgcgtaaaatactgacttccaggacagtgctctttctgtacctcacctcactggacctgctttgtcagctcatccatagatctgcagtaaaccttattattgctttactttgaacgttgatgctctaaagcatagtgactactgcttaacagtaatttatatattataagatatcacaaggaatgttattgctttctgaacatttaaatttaaaaatatgggacaccctattaaataaaatgactttcatatgacaaatctatttccttgttggaaaggccattcctggtgcatttaggatatgtagagattgttgggatagtttagatcagtgattcttgaccttttggaccaaatgtctcttggaaaatctgatgaaagctattggacgtttcaccaaaaaatgcgtatttttacgcatagatgtttttctcctctgcaccaggccaatgttctggaaacctcttctgcgtcactgtcctaatagtgtaattatttttagctgatactgagacttcacgaaagtggtgaaaaatatttcagaggattcattatatcattagacagttactagtaatgaatttttaaatagaccatgatgaagagtcaaaacattcaggctggacacgaaggcacctacatttgctatattagctctatgataactagagaagtgaaattgacatgttttgaaaagaaagaatttgggagaaaacattggtgaaggaaatggaaggctgtggtggttgagatttcttttagtagttttcaaagattgtttatttaaagtatcattagcccatcgtctattcagtgacttgtgtgaggcatagaatctgtgtaacctctgtgtcacaggggttacagagatgagcctgaaatgctcttcaaagttggttcagaggtccaatgtcagcacagaggagggaggagttaattccacctggaggaagtgacaaggaaaggatttcatggaggaagtcatactcgacagaagtgtcatagattttggataaattctgaaatgtaatgaagatgacctttaaggtgaccgtttccagattaaatgagttagcttggagctgtggcctaagttgaagaccattttcttgcttgtatgtatctgttcattcattcagtaaatatttgtcaattgtgcatcactgtatgccttgagtaaaatttgtggggtttgctctcgcttctctgctttgggcatattgcctcaaaaataaaatgcctcttcgaaaatctgatgaaatctgattgcctcaaaaatgaggcaatatgagttgatatttgactatactttttattgcccttggagtgttcagtccaagagtccaaatgtgcagttatgtaagaattcttttggccagagaccacttcactgaataatagagaattaacaatgtatcatgcagtgtactctgtgcaattcctaggtgatgatgcatatcaaagttgaagaaagatgtcactttcgggaataaagagaaagaactaggcaggtatacaccatagctacactaaaaccttgctccaacatgctcagcttgtgctctgggcattgttcacctaggaccttgcctttgggagtttattatgctatttgaacaatcaatcttatgagagattaaacaagctttcctaaagtgtgttttcaggtatacatttttttaaaaagcagagggtggataaatgctgagttaaatgggtctttttgctgcaggacttctcaggaccatatgccagtgtgcaccaggcatttcccagaaggagaaacagtatatggtgtctcaacttccatgaacattgatacttctccccagagcatctttcttgaggactcatgttccgtaaaacatttagggaactacagcccatcctagtgtgcagagtccaaggacagcaatatggagtgtccctggtgcattttaagtttcaatgaaagattggggcgaataatgaattaaggggtaattgcattccctaacttgggtgagatccttttatctaaagtgaagatgaatgcggaacaataatcaaataaattaggactgtctagacaaccagtctgttgaattcagggcaaattgaagttaattgttagctttcatctgtttattacttgagacagccctatcttttttagcctatcaaggggattagaagatttggcctttcctaaagcagagaattatgtatctgaaaggaagtacaaaatacagataggcataggtatagattagatagatagatagatagatagatagatagatagatagatagataggaatggttttatatatcaagggcaagtttgtgtgtatattgatattctctgttgtcttctgccaaaaagcacaatgctggttcaaagatcagagaatgtgctagcagtatttagaatctgctgacttacttaggcgtaaaggttaaaatgacatgccaccgtatccttgtcaatgtttcttagttgcttgagataaatatattctaggtagcattagaaacttccctgttgccctcatccacataagcatgattttgttttcttagtatgtggttcttctattcattgcaacaagcatttgggcactgcaacgtgcaggctccatcctagggatgcaaagatttgtaacacatttctgttttttcataacacacatatagctcatttatgcatctcaagattaatgcatctaaaacaagacacttgatatttccccataactcttcttcccctggctgtttccaacttaataaatggtacctctatttaaccagttgctcaggttaaaaaccttgaatccattcttggttcctctctttttgtcatacaccacatccattccagcagcaaatcctattggctgtagcctcaaaatatgttctgtatctcacggcttcccacaacaactgcaaccacagttatccccacccaagccgttgtggtcttttgcctttgtccaagccaccatgatctcttggccagagatctgcctctttactagtctctgtacttccttcctcttttgccccactacagtctgctttcctcacagaaaccaggatgatctttaaaaaagttaaaataaggtgaatcactcccctactcataagcctccagtagcccccatcatacttagaccaaaacctagagttttgatgtggtctacaagacactctgtcacttagtctcttcttacttttctagtctcatattctcctcactaatttccttttggctgtgctagccttactggtctttgagcacatcggcctttttcctatcttccccatatacttgcatggctcacttccttacttcattaagatctctgcttttgttctcactcataggtgggaattgatcaatgagaacacttggacacaggaaggggaacatcacataccagggtctgtcatggggtggggggcgggggggatagcattaggagatatacctaatgtaaatgacgagtcaatgggtgcagcacaccaacctggtgcatgtatacatatgtaacaaacctgcacattgtgcacatgtaccctagaacttaaagtatatatataaaaaaagatctctgctttaatgtcacctctcagatgcattcactgatgatcctgtgtaaaagcactccccacttccatggctcactctccccttactctgctttatttatcttcatagcacttaatatttccttaatagttcctaatcacttaatcgtaatatttattcctttatttgtctctctttcccataaaagtgtaagcttcatgaggacttagttatattcacctgtatcacagcacctaggatgatgcccgggactcagtaagagtgcaatattatttgatgggtgaatagatgaaggaatgactttagctaggtttatgatacttgtgaaggggtaagtatatgtacttgcagaaagattccattgttatccatgccttagatgcttctcatgaagacagcccacatttcatatatctgtaggctgtatttgaaacattttaaggggaaaaataatttggggtagcaaaaaattcttaatgtttgtgtgtactagttttctctttgcaaacacagtgatgttctacaggaaacatatatatgcagtacattcaagtgagtgtatattgaaagatgactcttcattccacttcagccccaagcactataacccaaaaataactgctatgatagtttattgtgtatcctttcagatatttactgtgcaagtatgaagtatatacattttttgctattctacaatgggcctatactatatacagggaatctcaactttgcttattttaccttatttatttcaaagaactttcatactttttaatagttgtatagtatttcaaagaatgcctctaccacatccttgtatgtagctcttggagcacataggtaagtttatatgtaagagagcttgctaggattgtaattgctggatcaaagggaggtccatttacagttttgatagctaatgacaacaaggttgaatcactttactttgccaccaacagtgtaagacagaatctgtttttctgcatccatgtcaatactatgttttaactattttcattcttcaacccaataagccaaaatggtaccttatttttatatttctccagttatgagtgagattgaacaatttttcattgaaaggcatttacatttcttctgtaaaagtttatgttcacatttttttaacctattttaaaagcatgtctggtcatttttccttattgacttgtgagaactttttatattttgaagaaatgaactctttgttgaatgttgcaaatattttctttttatggcttctgggttttgtgtcttgcacagaaagcattctttattccaagaatattactttagaaaaatctgccttactttattctagttttttaaggtttttatgttatgcatttaaatcttctgagtttattctgagtaaagagttagagagagattctgctttactttttagatttccccaaatcagatgtctcaacacaatttattgactaaaccaggatttacctactgatttgtataatttaggctatttctagaccatatgctcttatttctctgtctctctaatcttgtaccagcacaactctttctactgtagctttgtcatacattttaatgaaaagttgagctagttataatgctttttcaggaatttcctggcaagctggccatgctatttttccatgtgaactttagaatcaggctttctaatataaagaaaaagttactaatattttaattgagatttcattacatttgtagatttatttggaggaattaaggtctttataatactatttccttttatcaaaaaataaaaactatttttctgttcaaatcttctattgtgtcttttggtgattttgaggatatttttcaggtttatttttcagagctcttgttgagttgatgttgctctaagaagtgagcttatttttttccatcatattccaattcattgtacatagggtagatatttatcttttaatattaattttggctgggcatggttctcacagctgtaatcccagcactttgggagactgaggcgggcggatcatgagatcaggagttcgagaccaacctggccaacatggtaaaaccccgtctctactaaaaatacaaaaaaaaaaaaaaataccctggcgtggtggtgtgcacctgtaatcccagctacttgggaggctgaggcaagagaattacttaaacccagggggcagagattgcagtgagctgagaccgtaccactgcactccagcctgggcaaaagagcaagactccatctcgaaaaaaataataataatttttaaactagacaccttattccttgaattttctttttgtttttctttcattcatttattcattccttctcatcaattttccaggctaagtttccactatccatccactatgataattttctctcttctctaatttttatgcctcgtttcacccttatctaatggcattgattagtacttgcccaataatgttaaataaaattggtaatggtggaatttctaccttgtttctgattttaatgctactgttgtttcaccattaagcatagtgttcaagccaatcactccaaaagctctggaagctctcctaaatcactccaggcaagctggcttaaggacctccatagcaccttttttttacctttattgtaatctggaacacaatgaacttgagaatgtgtttatcttactgaacaatgttgacaaattctgtgtacatcctcaaagaagtacttttccacagatcgccctctgggaaacacagatttagagaaatacatgatcaacaataccaaccatagcataaaggagtttaaggattgagacaaaaccatgaggcttagaaaaaaggaggtcatcagtgaccttaaggataatggtgatgatgatagctcatactaatggtatatttaccaggcatcagtcacttggctgagtaattatacatgttaccttgtttaatcttcacattacccaccaaggcagaacaattattatctctgttttatagctgtggcaataggctgaagaaactttcttaagattatcacacagtaaataataaaatgtgatttcaaattgcactagctctatagcaggagctcttccacataatactaggagaataaatccagagcctgccccaggaatgttttgtttggccaattcattatgggatttttgttttgttttgtttgtttttaaactgtgaatgccttcagtaggcatacataccattgaatttgtgagtgtttttcaattgcagtctctgaagttttatgtatttaatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgttgttccccttcctgtgtccatgtgttctcattgttcaattcacacctatgagtgagaacatgcggtgtttggttttttgtccttgcgatagtttactgagaatgatgatttccaatttcatccatgtccctacaaagaactcatcattttttatggctgcatagtattccatggtgtatatgtgccacattttcttaatccagtctatcattgttggacatttaggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggacattagccctttgtcagatgagtaggttgcaaaaattttctcccattctgtaggttgcctgttcactctgacggtagtttcttttgctgtgcagaagctctttagtttaattagatcccatttgtcaattttggcttttgttgccactgcttttggtgttttagacatgaagtccttgtccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaagtttaaagtagttttttccaattatgtgaagaaagtcattggtagcttgatggggatgccattgaatctataaattaccttgggcagtatggccggtttcacaatattgattcttcctacccatgagcatgggatgttcttccatttctttgtatcctcttttatttcattgagcagtggtttgtagtactccttgaagaggtccttcacatcccttgtaagttggattcataggtattttattctctttgaagcaattgtgaatgggagttcactcgtgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgactaattgccctggccagaaattccaacactatgttgaataggagtggtgagagagggcatccctgtcttgtgccagttttcaaagggaatgcttccagtttttgcccattcagtatgatattggctgtggatttgtcatagatagctcttattatttcgagatacgtcccatcaatacctaatttattgagagtttttagcatgaagtgttcttgaattttgtcaaaggccttttctgcatctattgagataatcatgtggtttttgtctttggttctgtttatatgctggattacatttattgatttgagtatattgaaccagccttgcatcccagggatgaagcccacttgatcatggtggataagctttttgatgtgctgctggattcggtttgccagtattgaggatttttgcatcaatgttcatcaaggatattggtctaaaattctcttttttggttgtgtctctgcccggctttgatatcaggatgatacgggcctcataaaatgagttagggaggattctctctttttctattgattggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctaatttatttgcatagaggtgtttgtagtattctctgatggtagtttgtatttctgtgggatcagtggtgatatcccctttatcatcttttattgcatctatttgattcttctctctttttttctttattagccttgctagcggtctgtcaattttgttgatcctttcaaaaaaccagctcctggattcgttaattttttgaagggtttttttttttgttgtctctatttccttccgttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtacttgagtggttttgagtgaatttcttaatcctgagttctagtttgaatgcactgtggtctcagagacagtttgttataatttctattcttttacatttgctgaggagagctttacttccaactatgtggtcaattttggaataggtgtggtgtggtgctgaaaagaatgtatattctgttgatttggggtggagagttctgtagatgtctattaggtccacttggtgcagagctgagttcaattcctggatatccttgttaactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagatagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatccttttattttgagcctatgtgtgtctctgcacgtgagatgggtttactgaatacagcacactgatgggtcttgactctttatccaatttgccagtctgtgtctttgaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttttagggcaggcctggtggtgacaaaatctctcagcatttgattgtttgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttcttgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagatttggtctcttcacatagtcccatatttcttggaggctttgttcgtttctttttatgcttttttctctaaacttcccttctcgcttcatttcattcatttcatcttccatcactgataccctttcttccagctgatcgcatcggctcctgaggcttctgcattcttcacgtagttctcgagccttggctttcagctccatcagctcctttaagcacttctctgtattggttattctagttatacatttgtctaaatttttttcaaagtttttaacttctttgcctttggtttgaatttcctcctgtagctcggagtagtttgatcgtccgaagccttcttcgctcaactcgtcaaagtcattctctgtccagctttgttccgttgctggtgaggaactgcgttcctttggaggaggagaggcactctgctttttagagtttccagtttttctgttctgttatttccccatctttgtggttttatctacttttggtctttgatgatggtgatgtacatatgggtttttggtgtggatgtcctttctgtttgttagtttcccttctaacagacaggaccctcagctgcaggtctgttggagtttgctagaggtccactccagaccctgtttgcctgggtatcagcagcagtggctgcagaacagcggattttcgtgaaccacgaatgctgctgtctgatcgttcctctggaagttttgtctcagaggagtacccggccttgtgaggtgtcagtctgcctctactggggggtgcctcccagttaggctgctcgggggtcaggggtcagggacccactttaggaggcagtctgcccattctcagatctccagctgtgtgctgggagaacccctactctcttcaaaactgtcagacagggacatttaagtctgcagaggttactgctgtctttttgtttgtctgtgccctgcccccagagttggagcctacagaggcaggcaggcctccttgagctgtggtgggctccacccagttcaagcttcccggctgctttgtttacctaagcaagcctgggcaatggcgggtgcccctcccccaacctcactgccaccttgcagtttgatctcagactgctgtgctagcaatcagcaagacgccatgggcgtaggaccctctgagccaggtgcgggatttaatctcctggtgtgccgttttttaagcccgtcagaaaagcgcagtattagggtgggagtgacccgattttccaggtgccgtctgtcacccctttctttgactaggaaagggaactccctgaccccttgcacttcccgagtaaggcaatgcttcaccctactttggctcgcgcacggtgcaccgcacccactgtcctgcgcccactgtctggcactccctagtgagatgaacccagtacatcagatggaaatgcagaaatcacccgtcttctgcatcgctcatgctgggagctgtagaccagagctgttcctattcggccatcttggctgccctccagtctctgaagttttataaactctattcattcattaataaattatttcaacaaatatttcctgagtgtccactgcatgccaggtactatgctaggctctggagatacagcaataagcaaaaatgagcaaagaccctattttcgtgtaggcttaattaaataacatacaaaaaatgtgtgtgtgtgtgtgtgtgtgtgtgtgtagtgccaggtagtaatgtgtactaagaagaaaaataaattcagggtagcagggacagagtgtgacagatgactatattgattgtctgcattgatggtggggtcactgggcattttttatgaggagtacactacatttccaggtttattcaagttaggaaatggagacatctgatcatgtgttgtagaaagaaaatcagaaatcacataggagctgaaaagggtggcatgagtctaattgaggaatttcttacttttctgtgatagaataatgtgaatattcttgaagaaataaggtaaagcaaatggccctgggagaggtggagaaggcagggctaagtgtggaagctaggttccaaagtgacagtatgcctgagatttatgccctgggaagcaaagggattatttcctcaaaagcttcattgcacaaattaactcccaaggtatgctatgtggataaaatcatctcctataccagttctctggggacagcaaccattttgggttgttggaagcattgcagaattggtggtaacacagtttctatgggcagttgctttaagaacctgaagcttgttttgaggttgccatggtaacaccactgctggctgcatacaacatctcacccaggctctcttgatctaataaccaggacccacattgccttgaactcccttaaacaaagtgtgcttttagcagactagctttttttttttaacctctctgataaatccatcaacctattttattttggtttctgtaaattgcaaattactgaggagagagaaattaggagaggaattgtattgttttaaactcatcatcccgatttagaatacttaatgcaaactaattaaagatctgcttgtgctatgatctgctattttcctgttttcaagtttttgcattttgaaatctatcatatctccttgttcacacaataaggccttaacaaactctttgtgaatgtagtttctctgacctctctactctcatagaaaaccacaggatactcaggagtcttgggctcttttcttcctaatgagctctgtttgccatggtttaggagaggaagaactctgagtataggggatgatagattttgctagtgttcacttagacctcttctctcaaaaacatgggtgagagaatcacaaatttttgacactaggatacttgacagtttggcccagtggtcttttaccaagatggctccacatctcctacatcccaatgatgatcataaacacttgctgatttaatagacaataatgttagtagcctgaaatcacactagtagtttgaaacccatgatgagggtacagatacaccatggaaatctaaatgctgtgaaacagtccccgcttcccactgctgggctggttgttaatcatttactggcatacctgtatcaaacccttcccttatcatgcgggtggggagtggtgagaaacaggcttcttatcactagattctatgtggccattaaatgatggaaaataaaagaaagggagagctgtaatgcataatgctcttcatttttgtttagtaatttatattactttggaacaagatgaaataaaagatttaagatgagatttttctctttgcataataaaatgtgaaaaaatatttgattacaaaagctatctttatagtagccacattttatttggtgacttgccttcagacttaagaatcttttctaacaattttatcccatttacaaaaaaatgctcaataaatatttcgaaagattaggtcaaaagcccttaaactaatctgtagggttgacaattaagatatcattttttttctataactgatcattgaattttgtagtgatgagggaagggtagaatgcatagtgagtgacacacaagtacaaaaaagagttggttataatccaagacttacatcttaaagtaggaataatttttaggttttgccattcaaatcagcagatagccacagttattacattacaaaagatttctgagctccaagtgtttgcctgtactttgacttactaagcattcaaaaatattttcctaacagcatcatacttttattttcatgttgtatatattttaacctttaagttatcgtggaaattccttaacagggtcttcttcccagtaaacatgcaaactgaaacattagcacccatttattcagcatcttagaagaaatatgcttaatatagtagattttcctaaataacttaaaccttaacccttcaaattctaagaccttttagaaaccatttatctgaaatcctttttaaatattttaaacatatttcttatttcttaaactaagaatttaaactctccttgctgtgatagggcaatcgtttttctgcaatgtagaaacaactactttcaccagcttttaaattttatttagttatatccttaaatgccaaactgcaaaatgacctttgtcactggtgtggtcattgtattggctcagaagccctgctcccccctccccttttagtttcctgagtagtgtttatttattattggcactgaaatccattcataaaacttgtttagagttacatactagattcgattttattaagactctaagtgagggtgtgagaaggaaaatccttcgcttttcagaagactttgttgtggtcatatcaggcacttggaatatggagataatgaaatctactccaagggatggttgtgagaggcaacaaggaaaggcatatgaaatgaatctataggatgctactgagaggtccctttatgcacacaactgctacaggccccaccactgttgttcaaagttccccaccgctccatccccttaggcagtgtggggagagccagtttcccctccttacaagaggagctgccagagcaattccagtagacccttgggtatatttatctacctaactggtttttagttaggttgatgaaagggaatgagaagagataaaacttttgcatctgagtttctctgtttttaaatatggagtattactttgagcctaaaaatgctcatcactttcgacttagtaatctcccttctagaacttaaccctaaagaaataatcagacataaggagaaagatttatgcataaacatatttttcatctcactttcatcccatttttacattagtcagcacaaactttggctgtgttccagaaaacatattgcgccaagactggcagacattggtttgagtttatttaactgtcaggggatggcttttctttgtgagctgattccacaaattcattacatacttaaatcttttatgggcatcagcaatgtaagagtagtgtacttgaagggctcaaaattgcacacaaacattagcagatagcagtgctggatattatggtttagacttaatatcttttaagatattttagatcttgtagacccaaactcatccttgatttggctatgtgtattctatgacattctgtatatgagtaaaatactgggttctgtgagagcaggcatcaagatagaactagctgtttaaaagatttattgtgggaaaagcccgtgaaggataaaggggaaggagagcatgagtagggaataaaaaaacaaaaaatagggtagtcctgtataatttcttacaatttggattttgttcatttcatcccagtagtattatttaacatgttcctctgtcccctaagtatcagatacagagggctgatcacattagaatttaatttgttccttccttccttctcccctctcctcccctccatcccctcccattccctctcctttcttcattcttggaaaactacttcataggtgatggtgtgtgcttccatcaagagtcagataacatttgtctcatctgtttttctgtgtgtgttagcagcttgattatcattatgctagatccattaattcattaggggttgcaaaatgctgacatttgaattatttctgtcttcacttactaactagcatacttttatacagagaaacttcccctcattagctatttggttgttttgaggttcagcgcaaataggaaacataggatgaatactagattttttcttttgcttaccatttttcaaaatggtaagttgattccttagcattttccaaaggtggaaaatgagagtttttgtgtttgtttagtattattatgaactcatggatttaagccattgtagttgttatctttatttgacactcaaattatttcatctttggccagtaggagtttatataggtaggctcctaagtctttttgacagaatcctagtagtctctgacagccttcttgctttctggtatgatttagtgttcaggctcatcttgtacatttcctgcctcaggtctcactaggtcacaagccatagttcattgtagtgagaattgattttttagaaacaacactgtaagtgttgggagtgttcattgctactgggtaggttattttttctagaccttttcattgtacaaaactaagaaatatttttttttaaagttagagtatatccagagatcatacttataattccaatttatatctaggactacagggttactacttcatctcatcattttttacatctgaatttctttatctccatgctaaaaaacctgcttctcagcaactcaagcctgattactcacttgttttatcacatactacaaatgtaacagccttgggataacaatgctaatactaggactagctaaattgttattgaaaaaaaatgtgaagttcttttttatctttaggatatataccattagaaatgaactatcaaatccgtgtattttaaaatcagttagaatagttctcctcctcaaccacttgtatacatatttaggtataatttgtatcactttactaatcttgtctctggtgccattcttatttccctctaccctaatataactagcattttctccctgtattatgtttatctctgtaataatgagaagtctatgagaagtataatgagaagtataaagttaactaggaactaagacagaatttgaagtacaaaaatgaatgtggatttaaaaataaatgtatgcacaatagcactatatatatatatatatttttttttttttttctttgagacggagtcttgctctgttgcccaggctggagtgcagtggcacgatctcggctcactgcaagctccgcctcccgggttcaagcaattctcctgcctcagcctcccgagtagctgggactacaggtgcccaccaccatgcccagctaattttttgtatttttagtagagatggggtttcaccattttagccaggatggtctcgatctcttgacctcgtgatccacctgccttggcctcccaaagtgctgggattacaggcgtgagccaccgtgcctggcctatatttctttgtgagctgagaggtcttagaagcaatgacaccccagtagcaatgagcacacctagaacccagatcttggtttctaatactgttctccagtaaaagggaccaaagctcaatgaagaaatgcctgattctaaggctgtggcagagaaagataagatgagtcgggagcattgtgtagtactagaaaggaaggaagtgtttaaacacacacacaaaatgataggggcatgtcaaaggggcataggagccaactaacagaactcctaataaccatagctggaagaatttgagcaacgaaataaatgacatagtgttggattataatccaaagtataaaacaaatatctgcgagtccatattgatatattaataagtaaatgattgaaaaagtcagtaagtgaggagaagagacacatctccagtgcagaattccaaataatttatatggatactctaccctcaaaaagctggaacatacttcccactccttaagtgtaggctatgcatagccttttacagtatgttaagatgggaaaaagaataactatagtggaaaaacttgacaaacaccacctcagccaggtgatcagatcaaggtcaacatcagtgataaatcatgcttgtagcatgcacccttgatataatgttaatctgcaatacttccttaatttttctggtattactatgttgggtttaaaaaatattttatctatcctgaaggcttttaattacaggtggaaacctgttctcagctttgtttgagctagtgaaaaaagtatgaagcatggtttctaccttatggtaacttagaaactagtgaaggaaacaagatctagcaagcatgtaatcaaaatataaatcataggacatgattatacaggatttttaagttgagaaaagcaaagcatagctatactgagacctggtgtagctagaggaagttttaaagaaaatagtctcttctgttaatactatcaggatttctgtatgagggaaatgatagggattgatttagaggctcaaaaattctctaaatatatgattatcaccagaaaacaagatatatatattttaagaccattacattttgtttctgttgaccaactgaaatgcaagatgactaaattagttatttttgaatcccttatgacagataataaaaattggtggctcacttaatcacagtgtggtcagaatttattagaaagacagcaaaatcattggattgtatatgataccctgcatttatttgatgtgtagacctggttaaatcttggattttaagcatttgaatgttacgttgctcttttttgtttttcctttaggactatctgctgccaaactcttgactgaatatggcgttagtgttttggttttagaagctcgggacagggttggaggaagaacatatactataagggtaagtgattttaatacttacatgtaatgtaatatctcactcaaactacaagtggcaccactggaaatcacagggctagaggaggtcttaagagttcatgcagttaagccgtttgtcctccatagccctaaagtactcccatcaaataagcgtccattctctttaacatgtacgcactgaagactgacagcttctgaatttcagtggagtgaattcaaaaaacatgagcaaataacttcaatacagtgtcataatttccatactagagacgtaaatgaagtgtgtagtgtctcagatggggtgatagtttggctgtactggaagtgactatacacccgcaatacacacagacacacacacacacacacacacacttagattccctatttatccaatgacacacaacttaatagaaatgtggtggcaaaaacccaaaaaaccaaaaacagacaaaaaaagaaatgtggtggctgcagtaagcaggaacaaatgtagcatatttttgcataacttttcccttggcccttgttccctaagaagtatgcttctgccagagatactcctcaggtcgcgtctggctacatgtaagaaggaagcccagttcttgctacatcgctgctttttttatacttcggcttacatcaccattctggaaaaaatgcatgctattatttactactattaagggaatggttgcaggtggttgactctgtgggtactgatgaaagtaggcagggagataatgaagagtgggaaggaaataggggcaaagatggaagtttttgcacataaaagtgggggagaaagggagaagagtcagagagaagtagtagaggcagaagaggaggaccagactagaccagcaatgggtaagtcagtggacgaaagaggaaggggtgctcaacagtcaactgacacaatatgaaggcaaacaaaacaaaacaaaacaaaacaaaacaaaacaaaaaccctcgcatttgacagaagttcattaattaatgagcccctttgctagagtacacaaatagagtgttaaagactagggattgagagtaaagacaaaactagactgttgaagtgactggaaagaaaggaagcatctatctaactagaagatgcttcagttagactaataacagaatggcgtaagcaatgcaaacatttgattatttcacagaagtctggtggcagatagtccaggctggtgctcttgctttttgctcttctttctgctctgatattctttcttttcttttcttttcttttcttttttttttttttttttttgagacggtgttttgctcttgtcgcccaggctagagtgcaatggtgcgatcttggctcactgcaacctctgtctcccaggttcaagtgattctcctgtctcagtctccagagtagctaggattacaggcaccccccccaccacgccagccaattttgtatttttagtagagacagggttccaccatgttggccaggcttgttgcgaactcctgacctcaggtgatccactggccttgaagcctcccaaagtgctgggataacaggcatgagccaccgcacccagccctgctctgatattctttgcatgtaggtttattgtcttgtggtaacaagatggatgctgagattctaagcatcaagttctcattcaaggctgaaaggagagtgaaagggtggcactagccttgtctgcaactaagcttttccttcgccaaaagaccccagcagacatttgctttagtctcattggctagagttgagtcacatggctaccctcagctgtcagggatcctgggaaagtaagtatttcacaatactaggctacataatggaagcaggcatgggagaggaaatatcaatggatactagaataacctacagacaacatttgaattaggatttcatagcagcgatttcagccacattgtaccatgctacccttctgtcatttgcttcctacctttttagatacagggatgtatctaggcctatttctgctttgctcagctctaagggtgctgtacagccttgctatgcaaagtgtcatctgtgggtcagtagccccagaatcaactgggattttgatagaaatgcagaatatcaggccctatctcagaactgctgaatctggatctgcattttgacaacatctccaggggacactatagaagtgctactctgtggcatttgtttgcttgcttgccttaaactaatgccaatccggattaaattttctgagtgctcccttagatgtagtccactgggaagctattggtctgggagtgaggagactgggattctagcctctgtactgacttgacatgatgtcttggataagtcctattagcactttacatctcagttttctcatctgagtaataagatactatctaaatgtcctcgaagaaactcccttccatcttcaaattctaattgaaggcagcgtgttatagtgcaaatgaagagctgcatcttctgcctgtatgcctttattagatatgattcttctgtcattttctgaaaaatattcctccactttggagatagttattaagttgtcccttagctctatttttcttatctctaaaaccttttggttattaaacaggagcattagtcatgttgcggattttcagttaagaacaagtttctttgtataagggaaatgagaattccaacatacttgtccccatctgtgttattggccccaattactttgccatgctgtgtcatttatatatgtcagcaccacacaggaactgttattgtctattcagcatgacattacaccccccttaggaatgtgagaaaggaatctctgaaatgcttggaaattaggacttagcatttatactccaaatgatgagaaggagagaaagagggctttaagaaacaggcatggaggccgggcatggtggctcacgcctgtaatcccagcactttgggaggccaaggcaggtggatcacttgagcttgggagtttgagaacagcctgggaaacatggtgaaaccccatctctactaaaaatacaaaaagtagccaggtgcagtggtgtacacctgtagtcacagctacttgggaggctgaggtaggagaatcacttgagcctgaaaggcaggggttgcggtgagccgagattgcaccattgcactccagtctgggtgacaggagtgaaaccctgactcaaaaaattaaaaattttaaaaaaggaaacaggcatgaaaattgtatttaataagaaactgaagcaaatattttttaaattgcttctaataacataatcaattaggataattttgggaggagatgccataaaagctactatggatctctgagtaccagaatgtcaaatttggtattacctggcaagctgttcagatgcgtcttccattagttcagaacttgcccgtttttcctaatgtgattcatccatgattcttcagagtcaaattaataaagttgaaatgcctgcagggctgccacagggttggtgtatgtttccaatattgttgcatgtttgtggcctcttcaaaggctgagtagtgagatctaaatcaagaccccaaagactgaggtgcaacacagtagaatacagtgttaccgcttctagtgtcttcatgctgaatttgaggcacttcatttagaacgttcttactttgtaaaggaacattctgcaaaatgcctcactctttttactgcttcatttaggattatttgctttaaagatagtgtcagcattctaaagacatcatgtttggaaactcccaggagtccccttgctgtctttgttaaagcccagaaatttattggagtactaattccagttttgttcattatatcttaaaatagttgttgtagattagaaaaggtttgaaggacagcactgatggttactaaaagagagaataaacattatatgagggcacattaaagaagtcacagaagcacttcatttctggtattatggcagaatggaaaccctaactcctcattgaaataagtaaaatgctgaatacaatatgctgtgctcatctgacatggaagttagaaatttgtagatctcctggatgttgcatagacatctcaaacgtaacacatccaacactagacttctgatcttccttaaggccgctgttccagctgcccatgttagaagatggcaacttcgaaaaaactcagagtcatgctcaacactaccagaccctcatttgttttgtcaggaaattccgttggccctgccttcaaaacatatccagaattcaacgcttcccaccacttccactgctatcccctggtgggagccaccattatatctctaggccagattactagagtaggctcctgattttcctgcttttactcctgccgcctacattctgttctttcttagtgcatcagtgagagtgagcctttcaaatgtaactcagattttagcatttccctgctcaagaccttccaacggctccccttctcactgacagccaaggcctatgtccttacaatgtcctgtgaggctttacgtgacctgctctgccaataacctctgtaacctcatcttcaatttttttccttgctcacattgttccggccactttggcctccttgctatttcttgaatataccagcagacttctgtattacagtctttagatccatgttgctaggagtttttgctttttttttcgagacggagtctcactctgttgcccaggctggagtgcagtgggacgatctcacctcactgcagccactgtctcctgggttccagcaattctcccgcctcagcctcctgagtagctgggattacaggctcacgccaccatgcccggctcatttttgtattttcagtagagataggttttcaccacattggccaggctggtgtgttttaatttctacacctggaatgtttttcagttatttttcgtcatcactgcattgtggtcagagaatattgtttcatggtaacaatccttgaggctcgctttataacctagcaagcacatggttaatatccaaagatcttctaatttctgcttgaaaagaacatgtagtctctaaaagctatatgcagtgttttatatatgtccactagaataagcttaactgtgctccttcttttttgtttgcttaatctattaatcacttttaaaagtatgttaaaaattctctgttctactgggcacttatctttggttcctgtcaaatgttgcttacattttgaagctatattactcagtttatgcaagtttaaacttggttagccttctggatcttttagcattatgtagtgacacttatttcactgagatttattttgtttaaggttttctttgatattaatatagttataacagcttacattagtatttgtatatctctttatctttcagttagagttttctttattctgactttttttcctttttttaaattttagattcagggggtacaggatttttatttatttatttatttattttgagacagagtctcactgtgttgcccaggctggagtgcagtggcgcaatctcagctcgctgcaacctccacctcctgggttcaagctgttctcctgcctcagcctccccagtagctgggatcacaggcgctgccaccacacccaactaatttttgcatttttagtggagttaattgacaaacttggtccatctatatttgttatgatttcttttttaaatgttttaactttattatattatggctttccatttgtcccactttaacagttttcctcttggtttctttctttccttcttttgggttaatggttttcttctttttgttttctttttaagttttttcttctacttgttcagaagttatatagtcagaccaatgtttttcagacaattttcctaactatattaacactcatacttaatgtagtctaaagtttatcaacatactatctttctactaaaaaatacaaaagctttcatgcttcagttgtgagcacccttcttccaatctgtaaactataaaagtatttcaagtttgtatgtttctcagacattattaattttattttattctattgttgatgttgcttaattttctttaaagttttgccagtatctttgttcactgtccattcttgaatctcagaccttttatttgtaaccattttcattctacttgaaacacaccctttcctccaatctgggtcctaaactctgtacacttgtcagcttgacaaaaacatagttctaacaggtaacaaattctacttagaatttctcttcctctttttttttctctcagaacagcaaagatattattcccctatcttctggcttgtatttttattgttgaagagtcactcgtaagtctaattgttgatttttttcagagtatgtatgatttgcctcttttgttttctgaaaaagaattgcttttaggagctcttttctttggtatactgcagtttctctgtgtctgggtgagaatttcttttttatttatcattctttggacctgttgggtttcttatcttccaacaatgctggtaaatcctcagccactattttttaatactacttaatattttgacaccatcttccatgtcttaactacctcctcaacatattttccaattctttatctttgaactgcattctagataatttattcagatctagcagtttactcactctttaactatgtcaaatatatggtttaatccattcacggagttttaaaaattttaattagtacatttttattgctagcagttattttttaatctacttgataatattttcagtttcttttcccctgctcctagttttaatgacttattttatttaaaatatattgcatagtacttttagattctgtgtataattcaactattatgaaatctttctggattattttttctgcttattttcttttggtgccttgtttgcatgtatgttttgtaacttttggctgtgggttgctaattttccatggaactttatctgtgtgtaaattatttgaggcataggggaaaaggacttaagtctacttctaccaccgtccttgacactttaaattttctgcccaagttttttcatatcatatggatagcttaaattcagatggaaaacataaataaagataagctttttttttccttttctttgtgacaatacttagagctgcaaaataatggaaaatataaagtcgtggatgcagctaaagcaatacttagaagatgtatagtctaaattcttccattagaaaagaaaaaggctatatatgaataagctaatcatgcaaagagttagaaaattaagagcaaaataaatccaaagaaggggtaaaaagggaataaatcaatgatgtagaaaatagacacccaacaaagaggatcaataaaataaaagttgattctttgaagagacctattaaagatacacaagaagtgtctgataagatttttccagaaaaagaaacaccccaaataaatacgagatcagagccagatgtggggctcacgcctgtaatcccaacactttgggaggctaaggcaggtgtatcgcttgagcttaggagcttgagatcagcctgagcaaccctaaccctacaaaaaatacaaaaattagctgagtgtggtggcacatgcctgtgatcccagctactcaggaagctgaggtggaagaattcatagagcccaggaaagtcgaggctgcagtgagccatgatcatgccattgtactccagcctgactgatagagtaagaccctgtctcaaaaaaaaaaaataaaaataaaaaagatgaaaatgaagatataattactgatgcaataaagaataattaaatgaaaagaagatgccatgaacattaaaccaacagttttgaaacatatatgaaatgtacatattgtgagaaaaatataattcatcaaagttaacagtgatttagtctggaaatagaaaagatgggtagtgctttaacctaaaaataaattaaatgtctagtttaagattttccctaaaaaaatcaccaagcctagctagttctacaggcatgttctatgtaatgttcaaagaatggatcactttatttacatacaaacctttctagagaatagaaaaaagtatgatcactaaggagattagcagtactgtaatgcaaaaaacagacaaggcagtagaagaaaggagaatcataggccagtctcaatattgcttataaacatagatataaaaattctaaacaaaatgttagcaaagcatatcctccaacagaaagataatatcacgttgggtagctccaggaaggaaatgttgaataatactagacaattttctggaaatagcagattaggtaaattataacaaaatacaaagagactagacaagttgcactgtatagacacacacacacacacacacacacacacacacacacacgcacgcacacatctttaaagcattaaagagccagcgagctaacaagatagtgaagaatcactgggccaacatctggaaaggattaacctacttttccctgggtggcagggggagttgctgaccactgaagaagctcccgaagctgagcagtgctttggacctagtgcaaagctagggtgacaggtcaagtccagagccccatgaagtgtgtactgatttctgggggagtgtttgtcaactccttgtgctgtgggttgggctgcatctaaggaccaagggtaaatggcaagaaaactaggccaaatgtgcatttcggcccagcttcaaatcctctcaggtactgaaaatggtataaagttatctggtactgtgagagtcccaggctgtgggcagaagcaaacataaatcctctctgagaaagatatcatcttcctaggattcaaatgatttctacatgttttcaagtgcaatgagtggcattcaacaaaaaataatcaggcaaacaaggaaaaaatgcatgacaacatgcttgagaattggtatacacaacaaaatagacacagaccctttatttattaaaaaaaaaaaaaccacggaagggttgcagctcaccaatattcaattattgattaaatcattggaactttccaattaataaaaacagctgaaaagcatggagaactgtatttatgagggaggaagtaaacaattttagtttatgatagagggtttgcatatttgtaaataatttagtgatatgtgaatctttttataccttcttgtattcttttcctatgacgcattctttcctggaagtgttttaaaatagcatctagagccatcaatgtggactgatttaagatttcacctggtggaaattagggaattaggctttgggtggctcctccagcaataacaccagacagaagctcacataataatttaaatgtttcataaaggatctaaactggcagaacatactacagtgttctttatcttttatgcattgtattgctgaattggccttaccaataactttaccaaatgatggtgcttagtgatgagtgttagacaggattgtgccccagttcttgagtggatgaggaaagattgccattttcagttgctctttataggggagatgtaaggcacaattaacttttaaaaaaataaatggggttatttttttacaagacaccttttttccaagttttaactaaagtcctctgaccaatttttctctttttgcagaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggtaaggctgacttttcacccaagtgactgatagggaagcattttatttgagaaaacatttggtttgtttttagttatttttctttcaaagcaattgtaaaagtaggctcttgactttgaagtagtatttgcctttcttttcttgttttcttttttctttttcttttgaaaaaaatctctaaagtctcctggaatcactgcaggatattatgactcagcttgaccttcctccctgtcaccctcagtggccctcacaagctatcctcactcccagaatgggaggctctgggttccctcctaatgcatttgaaggccacaggggtgggggtggcaggtgcctgcaacagacatgtacacacacacacacacacacacacgcacactcccctcccccagctacaggcaatccctgagcaacctagggagcaaccctagagctccaaggaacacaagagtttgaggccacttctttagcctttgaactggttattcatcctcattcttacctggcattatttggaatgcttcatttcctctgtacctggccttcactcttgggaagtctagcttgtttgtgcagtttcctactgtttaaacaagagattgtttaaactctagccactgatttccacagctgttgccagtgtttttctttctcactgaagccaaacatggagtggctggagtctggaaacatgccttgagaaatcaaagttcccatctgacattgcagcctacttcctagagctagtgtcactgaggaaggggtcatttactcattctaatgtcaggattcccacaccaataaccacatcatttctcaacaaatacatcccttcccctactccacctcgggcaataactgtgggtccggaggctacagggctttgggtgtgtcctgggagttgaggatacttgtgacatatgtacactgataaccaatcaggagagaccagaaacctttgtaaactctgatagccacatggtttgagatgcttgggatagtctggtggtgacagatgtgaaaaagcaaatcagtagtctttttattcttttctttttacctttaagctctgttggacttgaaaatcagtagtctttagaaaaactgtgggttcagaggtcaagggaggaatgaagaaagtataaaaaatttcacaaagtatttaggaactctggctacaacaggctgtgatcaaaaaggaaaaacccctttgcttcctcattttctcttttctgcactgcacagtgtttccatggactagtaagtaataacaacagtgagaataatagctgctaacatttattaagcatttttacctgtattctcacatttaatatagggagagagaccaaaccctttgcgctcaactactaattaaacagtcatgtaaattcactctccactccaactgggaagcaaatgagtgtgatgattatcttggaatctgtgcagattcatgctgataagattcagaggctgagaggtttttagtttacctggaggctaacaataaacaacaactaaaagctttttatgcatgaactcattaaatccttacatccaccctgctaggcaggcattatcatccccattttacgtttgagaaaccagaagttcaaagaggttaaagtgacttgacaaggctataaaactcctaaaagtctacctaacccctgagtgcatgctcttcattatcccgatatatggcctagaaaatgaaactgaggactctgaatggagatgtgctggacctccaatgtttgtttgtcctcacacacatctacagtaaggtatctcactgtcaatatcactgaagtctgggtcatatgatgaggagattcagtcattgaaagaccactttttttcctactttcttactcttcttccagtttcatgttccttttatgtacattttaaaaactgggaaaaactggaaaaaactggaaatttacaagtatgtcctcaagctaggtacctgctagtctcccagccacgcccagtctaaaacttgatattgggctgggtgtggtggctcacatctgtaatcccagccctttgggaggccaaggcgggaggatcatctaagaccaggagttctagaccagcctgggcaacatagtgagacctcttctctatgaaaaattaaaaaattagctgggcatggtggtgcacatcctgtagtcccagctatttgggaggctgaggcaagaggatggcttgagcccaggaggtcgaggttacagtgagccatgatcatgccactgcacttcagcttgggcaacagagcaatatcctatctcaaaaataaaaataaaaaataataaaagtaaaacatgatgctaaggtgatagtttgaaagtggcacccataggcagcttttgtaagtaatttagctcctcattgttcttgatggaggcaaggtggagttaaaatgataaagttctgtttgagaattttgactttgcctgaaagtgatcaacagatcgtgacatgctatccaaacttcctaacaggaccttacaaattacatatcttaagtgttagactttctgatgtctctgaaattttctgggctttactgggaaccctgctttctagaaatccagatgtaattgttctgtactttaagaaggtggtcctgctgcaagctttaatagaggatgaactaatggaaagacttaaggagatgatgcacgttacattaggtgcctaagtaaggaaatgttaagagtagcatccagggtcccttttttgattttgttgctgctgctgagtcccgctgtaaggttaggtccacactaccctgaaagtcctgttcctaaagaaaaaacaacttcagctttctggaggggagaactgctcaactctaccatatttttatttcacaaaaatacaaatatggctgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccgaggcgggcagatcatgaggtcaggagatcgagaccatcctggctaacacggtgaaacttcatctccactaaaaatacaaaaaattagccgggcgtgctggcaggtgcctgtagtcccagctaccagttactcagaaggctgaggcaggacaatggcgtgaacctgggaggcggagtttgcagcgagccacgattgcgccactgcactccagcctgggtgacagagcgagactccgtctcaaaaaaaaaaaaaaaagaaaaagaataaaaaacaaccaaacaaacaagaatgcaaggcattgttaacctctggatctttgccattgcatggccatgcacatcaacacaatggtaatattagaccataattattgcatatgcagcacgtggcaggtgtgtgctaaaacacataccgtgcctacactttggacaacaaatggcacctttaaatcacagccgctgtggttgatccctcaaggtcagtaccgctcccatagtaataataatgactacctcccctactgagctcccattatgttccaggccctgtgccagggccttcacctccattatcttacttaaccctcacatggatcctaagttaggggttattgcgccatttcacagaaagagtctgaagttcagaggcccagtaacctgcctaagagagtaagggaattcagattaaggtcttttgactttatgctgtctcttgctagtccagattctactgtcagggactgtggactccaggaagctgccttacagtttgtgcttgtcctggctctttctggcagctctcttctgatggtcatcctgtgtccatcattgtgtccccatatgcagtgctggtgaccattttgctcaatcttttgacccggaagcctgaaagagcagtgttaactacctgctatgatacaagcactgtgccttggttattgtttgatggatgcagtaactggaaaacagccatttaactgtcagaaaataaagattgaagctctattttgaattttagtacttattttcaaatagctacacatttaagatggtaagcatcattcttttcattgaatacttaatctcatcgaatgaaaagatgaaaaatagaaatatatatcattaaaccatcctctcacatactttaacctttcagagaatacatattttcaaccaaggtagacaacaatgttaaggcaaaaaagtagtgggttggttaaagtttagtttatttgatctgaatgagtgcctttttgctagtgttttccaatacatcatatcatttctggaatgagaagtactcattgtagtagatgtttttatgattatcaggaaactatattagggaaaagcaggaagatatttagttcaatattccagataagatgattaataaattgtatactaaaagtaactctacttattttaaaatatcttaactctcactgtttttctccacttctaggggaaaagtgggtgtttccccaatgtgatagtgtattgggttaataatacaaattgtatttgtgacattttctgcattgctttttgacaacttcagctttcataatctaatacagtcaatattcgtttttgtaaataacactgaagtgaaaaggaagattgccattttctagataaaccaatcaataatctttgtggcccagattgcttcagctcttaaattttcccaatgcgaaaccttaaagaatgtttaaattgtttaaacactgtcaacagtctgtggcacatctagtcccagcttactctaggatggtttttactattcaccaaggaactactcgttacctttgttagattgtgtttacagtgcaagttttagcaagacagtgtatagttccaagcctgagcctctcagatggatactgaggatacaccttagtggtgtttcctctacctgatcccttccttttctgagactatgcctatctactacgttcatagaggattcacatcgatatgctaaattcactcattgcttaatatttatatttatgtatttgataaatatataagtatttacagagcaaaatctactctgtaccagatattgttccaagctgcagatagagtggtgaacaaatgatcaaaatttctgccctcatggtccttctaatctaaagagagaagacaagtaaacaagaacagtaaataaatattagctaacatttttgcctgtatccttcatggatcttgtgaatagaatccctcttctaattctggtttagaagatcctgattcttatataataggttcctgactggtttctacagtgagcagcttttatgaattttgtgaatttgacatgcttttattggggagattatatctgatctgtgaaattaacataaattaatcatatcattgtgaaccttaaaggtagattcttaaatggcatcagctagatatttttacacttgatcttagccaaaaagccaagaagcagtagctagatatgtttaaaacattctctttatcggttgcacatggtggctcatgcctgtaatcccagcactttgagaggctgaggcaggaggattgcttgagcccaggagtttgaaactagcccgggcaacatagtgaggcccccattgctacacaaaaatttaaaatataattttaaaaataaataaaataaaacattctctttatcagttcttctcttctgcatggcataaaggaagcagctggacctgaatgccaagtggattgattcattacttgcattagtaaataagatgctccatcattatgagtgtgtttcattgagttgtggagatcttttgttaaattttgcaatgctgtgtcttgcagaaaaaatgaaaatgttggattccatttttttttttttttgctttccatgagtttcctgcacatcataatgcaggtagggtgaggggtatggagagggagaacccagccagaaatggagcaaggcattttgcagaggctacttcaaaggagaaattgacaattacatgcattctcacgttcttcctgcttttcacgtcctctctaaataaaagtagagactataaatatataccacccatttgtttttagagagtggtgtgataaagatttatttaaaacaacataggctttgctgacagtaacagctcagcaagaatttttttttttctttttgtattggttctattcttcccacagccctttactccaggtttctatgccaacgactgaaatcaaaggcttttcacaatgtgtatgttctggaatactaagtaaattttgttgttgctaagagggaaacttggttttagccagcaggccatgtagaaagcagagtttgtcttaatgcttaccagatataacccctcacttctaatagaatttgacccatggcttataatagaatttcttttggatatgcgacatttcattttaagtttcttttagtaccttgtccatactaactcacagaagatatttcttttatcttcaaagaaagatacattttcactttcaacctctctcagaaggaaactcaagaagcggaaagtgtgaagtctttgtagggatgttgcttgttgtatatttgcctcctttcttttaaacacctaaattcatccctcctgatgccatgctattaatattgccttccacctgtaatgtacctatacatgttttacctcacttgagcttcccaatggtcctcagagtaaaaagcattatttttcccaactcagagagcgtaggagccaaagtgtggctttccagctctaagcccagtgttctgtgggttacatcaccttgttttttattccaaagttaacttgtgaacccttctagtaaactgctccaagatatgacaaaatcactttatcccaacaggctctgaagttgtaagatgcccctttggaaacagggactcctgtggatatgggggtggtcgttcatgggagctgtatgtgacacagtttatatttcacagttcacagttcatagttcacagtggttgtacatgggagctgtatgtggcacggtggcttctcttctcttgcaccctgagctgtagtctgagaggtcctctggccttcagtgagcacctggcagctaaacagcccccagtgtgtcccagttaggctcagcaggctgaagaccacagatgtattctattattttgttaaaatactaaatctggaggtctaaggcatggtttgaaattgctggctatatattatttttgttaaatgatccatgtaaacttattattcaaagtatggcccaagtattggccagtattttatgttataccattatatcctgcctgattttaaaaataacaaaaaaggaaaggatttaaagtggttcttgataagtattacaaatttggataagtcagggtagaagatagaaaaacaaaacaaaacaaaaacaccagttaggtaaggataggcaagtagttacaggcctgtgctcatgataagaaattctgttttgatgatagaaatgaggtaatacagaagggattgctttcttctctcaatcacaattctgagtaggttttaaaagcagagaggctaaaaatgtttacatattttcagtttgatctatccagtatccagtataaggatatatgaagatagctggtaaaaaatagtttttagtaactttcattcttttttccccctcactttggaaagacttcatttgctgcttgtgagttcccagagagcttaatggcagaattcctcttaaagctttgcactgtttagagagctaggtcagcattagccatctcctctcagaggctccttcttcctataaactctcaggattacatctcagatttggtttcaaaaatataaagttcctactcagtgacaacccaatatatagcaaaataagttaattattagatttttttcttaaaaaatggtaaagtacactaacataaaatttatcatcttcaccaattttaggtgtacagttaattcagtagcattaagtacatccacattgttgtgccactgtcgccaccatccatccaacagaacccctctcatcttccttccattcatttctaatagggactaattcactacaggaattgtttctaaccattcattgagaagtaacctagcatcaccctcccactggcagcacagaaagggggttaagtcagacacaaaggatttctctcacactcaggctgagggactttgtgatcacacataatcatgtagtgcctcagtatttgggttaatggccaaaagaactttgtgaatggaattaaacattatatgagcagcttcctcaagagaaattgctctagtctccataataactgaactcctggaggttctgacctttcaggttaaaatgtagttgcctctcagaggttaaaatctcctccttcttccttgctttctacttccttcctatttcttctcagcaacccctgtcctcacctcagtggcatgcacattactccaatcaaaagactcaatcattgatctttaattttcaaacttttgcaaagtagccttctaacagttgaaatcttaaacagcctctaacgtccaatgaatcccatatctagtccattctgggcacttcctgaagaagggaaattcagttgtctcatgatcacatgttgagccagctagaaaaccttttctgtcattgcctcatcctgctgcctaataggatcgatgctgccatgtaaccctctgtatcacgtgcagactcaaacctttttcatttctatgtcaaattcaatgaacagataccttttgaaaacctgctgggccacagagttttagtaagtgacagttattcctactttagagataagagaaagttataataatgagagtggttcaaggtcctacagaagtgagagagaaagagggacaggcataaaagcctagttaattactaacctttgcaaacacagagcttcaaactgaaaagagacaaataatgataataatgtcaatacctgatatttgacagtccagtactattttcataacacttcattttagtttttgctttgtgtttgggttttatgtaaccagaagaagaaaattcttgatggaatcacagaaaacttgagagttaattatagttcagtgtagtgaatgctttgatcctgaaggctgtgaaactgaatcgttttcattcagaaaatttctcatgtcaggtttttcaaacaaaaagaatgattagtaaactattctattacctttcattcccatagctctcctgtaatttgtaagactcaaatgatacacactgaaccttgggctgagatttaattttgtatatttgccaaagtacacagtagcctagtttccatagccatatctagcagataaatgtctctgaaaaaaaaaatcaggcttcagagacaatgggaggaaatcactgtggctcacacttgcggaccagcagtgggtgacaaaagtggaccctgggacacagacatgggtgcagtcactaattgacataattatttgagcatccaccagtcgagtagtcctgagtatctgtgacttttcctaatctgtagattaaaaaaaaaatactattctgatgtttaaatgctgggaagatggtgctaagagtataatggctcttagttcatccaccctttcattccatgccatcaccctatctctgccatcatggttataaagccatcactgaagtaacttcatctagtagtagggggcagggccacatcctcccagacactgtgatacacaaggtggatgcactcacttaacagcttagctgacaagaagttctgctttgccctttgcccctctctacctgctcttatgtactttctcactgcactgtcttgttacgaggaggacgggctaagggcagaaactcagcatgaagcccatgatgcacttgcaattttagctagatatacaagcaatttccttcctttctcctcgttgttgtggaatgatgtgcccttttgtccagaagggatacaaatgacattgtattcccatgtgtaacatttggaaaataaacattctggttgtcacagcttctatttcatcgcatattttcctgtgttatgtcatacttctgccagtgcaagccagaatgtgaagaatgcctaggggaatatttctcaagtgttttctaagcaacattaatcttaaaaatactttgcaaaaacagggcatttggtggtcagataaactttggaagtgctccatatcctatccctgtctttgatagtcaagatgcccattaacaaattaggagtcctaggaagcctggcaataaaaaaagactattgaacacaaaccaggatttcccagacttatgaccatggaaactattttcatataacacctataaagatcagagtaagagatgctatcacaggaagtgtttttagagatttaggttcacaaattaccaaaactactcgggaataaatagaaaattgaatagacctataataaggaaagagattgaattagtaatttaaaatctcccacagaaacaaacccagacacaaatggctttactggtaaattttaccaaaagtttaaagaagaattaataccaattctttataaactcttccaaaaaaatacaagaggaggaaagatttctcaattcatcctatgaggccagtattatcccgaataacaaaaccaaagacatcacaagaaaactacaaaccaatatccctatatagagatgcaaaaatcttcaagaaaatactagcaaactgaatctagcaatatattaaaaggtttatacaccatgactaagtaggatttattccaggaatgaaaggttagtttaatatacaaaaatccaataatgtaatgcaccaccatattaataggatgaaggaccaatagcacgtgatcatctcaatagacggagcagaaacatttgacaaaattcaacatccttttatgataaaaccactagaaaaactaagaatagaggagaacttcctcaacctaataaaggccatctacaaaaaacccacagctaccataatactcaatggtaaaagattgaaagctttccttctaaaatcaggagcaagacaaagatatttactctggccacttgtatttaacattgtactagggattttagccagggcacttaggcaagaaataaaaaaaaaaagaaaaattgtatttgcagatgatgtgatcttgtatatagaaaatcctgatactgactaaaacaattcatagaactgttaaacaagttcatcgaggttgcaggatacaagatcaatattcaaaaataaattttatttctaatacagtagcaatgaacaatctgaaatgaaattaagaaaacaacttcacttaaaatagcatcaaaaaacaataaaatacttagcaataaatttaaccaaagaagtgcaagacttatatacctaaagctacaaaataacattgaaataaattaaagatgtaaataaatggaggcatcctgtgttcatggacttaatattgttagggtgacaatacttcccaaattgaactacgtttttaacacaatccctttcaagatcctagctgacagtttttgcagaaattgggagattgatcctaaaatgtatatgtaaatgtgagagacccataatagccaaagcagttttaaaagagaagaacaaatttgaaggacccacacttcctgatttcaaaaattactatgaagctagtgtgctaaaacaatgtgtacttgtataaaaacaatgtgtacttctataaggataaacatataggtaaatggagtagaactgtgatttcagaaataaacccttacatttatgcccaattgatttttgtcaagggtagcaagacaactcagtgcaaaaagtaaaataagttatttcaacaaatgttgttggaacgactggatatccacatgcaaaagaatgaagctggacttcttctcacactatacacaaacattaactcattttagacctaactataagagctaaaaatataaaactcctggaagaaaaaataataaatctctgtgagttaggcagtgatttatttgatgatactgaaagcacaagcaacagaagaaaaaatagataaattggtcttcatcaaaaaaagtttttgaagtgttgtcatttgtataccatcaagaaactgaaaagacaatccatagaatgggagaaaatatttgcaaatcatatatctgataaaggacttgtattccgaacatataaagaactctaacaactcaataataaaaagacaaacaacccaattcaaaaatggacaaaggacttgaatagatactttgccaaaaaaaagatatgcacatgatcaataagcatctgaaaagatgatcaatgttattagttattagggaaatgcaagtcaaaaccacaatgagatatcccttcacacccaacaggatggctgtaataaaaaaggcagacattaataagtgttgtgcaggatggggcgacattggaaacctcacccattgctggtagaaatgtaaaatggtgcagccactttggaaaatagtttggcagttcttcaaaatgcagtgtcagagaaagaagagtgactactaataattaagggcttcttctcagggtaaagaaaatgttctaaaatgagatgtgatgatggttgcatgctctgtgaatataccaaagaccattgaattgtacactataaatggatgaattataggatatgtgaatgatatgttaataaagctgttaaatagctatttgtcctcacaatgtgatattttcatcttttttcacacttcctgtttctcctgagttaatggcatctgtgaaagaggaaaactatttttttaaaaaactctgtcaattatctttaattacacaaaagccgccagaagaactcattattgtttctatcttaactgttttgtttgtaatttctgtatataactagaatcccttggagaagatgacataaatttcttttaaaacccttcactgttggggccaggcacagtgggtcatgcctgtaatcccagcagtttgggaggccaagacaggaggatcacttgagcccaggagttcaagaccagcctgagcaataaagtgaggccccatctctacaacataaataaataaataaataaataaataaaaatacaaaaattagccatgcatagtggcacacacctatagtcccagcttacttgggaggctgaggctggagaatcacttaaacctgagagtttgagactgcagtgagctgtgatcacaacactacactccagcctgggtgacagagaaagatcctgtcaaaaaaaacaaataaaacccttcattattgatggtatggcatcatttatatctgagtttaatggttctatttttccagagataggactacacaattcaggcgcccattgcattggtagctgtacaagtcttgagacagaggctgagaatatgaagtgtcaggtcataagcaaacacataggaatgtgctgccagcccttgaaatggtgtgagaggttatagataatttggtattcataaacatggagcagaggcatgaaaaatgtaaaccataagactgtgccaatataataacaaatttgagggtggatgagttccccagggaaatgggaaaggggtgggcagaaggaaaggaaaaggctaaggatcagactctgggggattcagtggatcatagaaggaggggtcttggggaactaggctgaggcttgggacaactagcactatctgatggggtggtgtcagatgcagccaagtgctaatgggatggatacatcccttcatatctggctaaaaggagctcattggtgaccatagagaaaagggcatccacggacttttgaggatacaagtcagattttagaaaacagaaggatatgaaggcaatgggggcatcatttgagtgggactgttaaaagaatgcaaagaggatgacaaatgaaaaggacagacgtctccatgtagggtatgaaggctttttctagatagagtgaagctatgtatgtttgaagagagcttggatacctgcatttggaaagaggaagataatgcttttgtaaactattaatacaacacaaaactaccatcctatttaatgggtctcttcttagatgattttaaaatttaaagcattgttataaactatagaaaagaaatcatcaaaagattcatcttacaggctttgtcacaaaacaatgggactagaagggtctcaaggtattcatataagctgtacaggcatgtttctaaattaatctggaagataactcttttattttccagatgattaaagaaggctatttggcagcttccccagtgacttatgatactctaataacactcacttccttttgcttaactcaaatataaaagtacagagagatcaaactctccaacgtgccaatcaggaaatgctattttgcttactataaacttagcttatcttataggaccaacaataaagaattatgtgggagccataaactgccatctcctggcaatagtctcctgttattgtgaacattagtagattgaagatgtagtttctcaaagtcacttaagtgttttggggcacggttccagggacattgcgttctgcttgacataaacaatttctgctgtatcaaagacactgccctttagagattaaaggccactttggaaaactagtaagctttcagagtgtaggtacaaaatgaacttgaccattacactagatttttctcctttaattttaaagagcagtaatcatttggaagtattcccagagcccctgcttcaccctcttaggtcatgaaggcattccttactgagaagtggcttagtattgagaaactgctgacaccttggtgagaatactatagaaccacattttggagactgagagggtccacactgtcaggcagttctcactcagccaaaagacatcttccaggcccccctactgcactactttagggattcacacatgcaaaagtgttccccacatatgtgcatttctttttagcaggtttgggttttctgtgaaacgagaacagagaagccagaaactgataggggtgaaactaattgatgaaatcctttatcaacagcaaagaagtttatgttatgggcctttatggtcttcttgttgtttttttttttttttcttttgagacagtctcgcactgtcgcccaggctggagtgtagtggcacgatatcggctcactgcagcctccgcctccagggttcaagcaattctcctgcctcagcctctcgagtagctgagattacaggtgcctgccaccatgcccggctgattttttgtatttttagtagagacgggtttttttgtttgtttgtgtgtttgagacagagtcgtgctctgtcgctcaggctggagtgcagtgacgtgatctcggctcactgcaacctctgcctcctgggttcaagtgattctcctgccccagcctcccaagtagttgggattacaggcacccatcaccacgccctgctaattttcgtatttttttaagtagagacagggttttgccatgttggtcaggctcgtctcaaactcctgacctcaggtgatctgcctgtctcagcctctcaaagtgctgggattacaggtgtgagccaccgcctcttcttttaaaatattccgtggctcccatttctaaaatgattgccaggccagattttcctctttccttgaactctttacttctcctgccaccactgtttatcaaggctcagatcaaggggtctttggaccttgtgtgaaatcatactcaagttggcatctttctgtgaagaacttcgttaggaatgtgggacacattttgttgagttatatttataattcttttctttatgttcccagactattgagaatatttatttatttatttatttaagacagagtctcgctctgttgcccaggctggagtgcagtggtgcaatctcggctcactgcaacctccgcctcctgggttcaagcaattctcctgcctcagcctcccgggcaatatttatgttttttaataaaatttttttccaaagcaaagatcagttttgcattagactattccttgactatacgtacattttatggaggaaaatgtagatttttccagatttcagttaaaggaggaattataacaaggaccagctgctctgaggctgcccctgagctattacttaacctcagcccctctcttctccatagctatttttgttttctatgtaaaatgtctttgcccatttctctcagagtatgtattagcattttccaaagctgtttatgttccctcagtggtcgtcttccacccctgaagcttcttaagtctctatttttactccttagaaacagaaaaggtacatgtggaagatttctaagtttcacatttcaaagttctctttcttttgggaaagaaaaagttggaagtttaaaaatgcctctagaacaaacctatctccacattccatcaactgtataggaggcaggaaagcatgttttatgagcaaaggctttgggagcaggaaatttccattctatgatgtactagctactgccgctgggctttagtttccttatttataaaatggaaatatcaatagcgcttgccttcacagggttggagtgagcattgcacgagataatgcatatgaagggctttagccagtgtcaggcatagagaaggatctcaataaatgttagtgatgatggtggtgatgatgataaaggatttggagtctcaaaaagttgtattgcagcgttacaacataacattttcagataagaaacgagatcacatattctgccaaggttatttgaatttgctatgtggaagggaaaattacttctctgtcacttaatggctgccatatattcttactcagttaggaggtgtgcttacacgtgtttgtgatgtcttgtgtccttgccctgatggtcagaagttttgttttagccctttaaaaaatccaatacagctttcagtattctgcagtgcatgcagtagactttctacaagtaaatgttttaattaaaaaaatcaaattatcatgcaaattatactggtagaaaagattttggccttatgaacatttacaaggcattgatttttaaagtaaaataaattagcaaataaggccttataaactacctatttctggtctatttcctagggactcacctctactcaccattgcttctcttagcactttggctgttacacaatgaaatgaagttaatggtttctaataatgaatgagccatcttcatattagaggtcttggtaccaagcaatagaaaccaactcaggctaacaagagggaatgtactgaaaggaaatgagaggacctacagaactgatgtgaggctggaggaccacacttgaggatgagcaaagagcatgagagctctggcaagttaggggcaggaaccatagccatagtctttgtagcaggaagcatctgctcagcacttggccatggggaaagaaaacccacagtctactttcttctctatgtgggtgacccactccatggtcagagtcctctgagagtgtatgactggccaagctcagataacaggctcacagccaggctataccaggagctgggggtaggggtgtagagataaaaaaaaaaaatctatcattttctgtaatgggagctggtagctgggaccatcctgcctacacagctatacagaaaagaagagagacaatttcccagaaagaaaccaggatactaccaggaaaggggaatggatgctcggcaggcccacagtggcaagtgcctgatattccacactgctaataatctgattctttacatcaggcatagtctgtagtctagccagtctttattaagcctttgtagactttaaaacacagtataagacattccactttgctattcttgtcctatatgtggtctaaagacagtcctccacgtcatcatcctgctctcgtctaagtgggaacagctttctcaagagattagatgggaattcaggagttgagaatattgtagcaccagtattagatactaggatatgctacctttatttatgcataatttccaaataaatagaaataaatttaaagctattatttactgtaaattaaaaccagccaacacagcaccagggagattctgcacattttattaaattggggcctgtataggtataatgtattcagttgccatcaaaggtaatgtttctgacacagtagagggtctggttactttgcaagtcttaggttggttgcttttttgttgttttagaacaccattcaaatttaagatattactctttttgattgattctgtttgcttttatgttctaggggaaaacatatccatttcggggcgcctttccaccagtatggaatcccattgcatatttggattacaataatctgtggaggacaatagataacatggggaaggaggtaaaatgtgtgttcagtttgcacatgacccattactgaaataacaatggcaactgtttaatatccttccatagtgcagggaacattgctctggacaccaatgcatatcatttcccatgtacccaaactgcaaagttggtcgtatttccacttcacaaatggaaaaatgagtgcccagagattatgtaatttactcaagacctcatagcaagggaaccagcataccaacccactctcttatacaaatgcctgtgtgccttcaactctatgctactgagcatttatatgacatatttttgccaagtatctctacttacagttgtctgtctgtctgtaatgccattttagatagtaaaggagagaaggacttgctgccccaaagcttctttacttagtcttaggctctgtaatatcaatttgggacataaaatggttattagctttcaataacaatgatgatgataattgtcatcattataataattacatataaatttgtacatagacatatataatattatcactactattattgttttggcaatggcattaggacacagaatccaaagaactctaccccactccctgtctctatatagaattctatgccaatcacacatttcaacacagagaccaagagacccattttcagaggttttcatgagggccttcccgagaagaggtggcagttaccatcaaacctgagaggggacttcctttctctacagattccaactgatgcaccctgggaggctcaacatgctgacaaatgggacaaaatgaccatgaaagagctcattgacaaaatctgctggacaaagtaagtagacttgaccattcaaaatttactttttatcttcccttctcgtcttttatatcttgccttgaactgcagtgcttttcttaacaacttacagaaaaaaagaggaaacctagtaatctttcagtcaatagcaatgttgagggcacctcaaagtaggttagaacagaaaatgaatctaaaaattaagaaaagtgggtgaatgaagtagaacttcttttaatgaaagcattgtgtgatctgcaataaaatcaataattgtgttttcatattattgaaaggttgcctacaaaagcagtttgaaaagatattttttaaaaatgtggtacatttacaccatggaatactatgcagccataaaaaagaatgaaatcatgtccttttcagggacatggatgaagctggaagccatcattctcagcaaactaacacaggaacagaaaaccaaacatcgcatgttctcactcataagtgggaattgaacattaagaagacatggatgcagggaggggaacaacacacactggagcctgtcaggtggtgggaggagggagagcatcacgatagataactaatgcatgtgggtcttaatacctaggtgatgggttgatgggtgcagcaaaccactatggcacatgtttacctatctaataaacctgcacatgtactccggaatttaaaataaaataaaatggtaatcccatatagatgtggaatactaggaaatgagaggaaagctagtctgtagtaataaaaatgttcaattagaccatgtcttattagtttatgtggggcttactatgtgaaggcaccataccaggcactgaggaatgggggtgaacttcttaggaatagcccctaccctcatggagtttatgtttttctagcaggcaagactgaccttgagcacaattacataatgctaggagagttcctgtaacagggagaaccttacatggtctgagggtacaggaagcattctttgatgaagcaatctttaacctgaaactaaggagttagtgcatcaactaagaatgagccatcggggcaggggggagtcagaaaaggtgaacagtgtagggcgatggtatcttccaggaatgatacacagggacaggagagagaaaggaagaatggatgaagttggggggatagtatctgccaggaataagtcatggggcaggagaaagacaggaagggtggatggtgtggtagaaatcgtaccttccaggagtaacccatagggttgatagtagtggggcagatggtatgatctaagaatgacacacagtgtcaaagggagagagggaaggttggacagtggtggtgggaggagggaatgatatcttccaaaaattacccacaagggcaagaagggagaaagggataatggagaaagatgggtggtgttttaggaaagacccacagaaacaaggcgagatggggactggaagggtggatggcattgggggattttgtcttctaggaatgagccacagggattagggggagataggaaggactgatggggcaggaagatagtatgttccaggtatgatccacaggttcagaggggagaaaagtatagtggatggtgtttgccatggatgaaccaccaggatagtgggggagacagaaaaggttgatggtgtggtgggatggtatcttttatgaatgacccaaaggggcaaagggaaggcaggaaagatggatgttgcggggatatcatccaccaacaacccagaggtgtagtggggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatagcccacagagtcaaggggaaacaggcaacattaggtagtgtgtgtgtgtggtggggaaatggggcgggggtggggtggggagaatgaaattttccagctatttctctctctctggggagagaaagggaaggttggtttgtgtggatggagatggtatcttctaggaattacccaaaccagaagggtggatgtcttaggggaaggggaattttccagcaatgacccagagggatggtggggagacaggaaacatagatggtgaggcaagatgatgtattccagaaatgacccacagggcaaggggtagatacaaaggtggatggggtgagggagatggtctcttccagttatgacccacaagggtagaggggacacagatggtgtagatcatttggcaaaatggaattttccaggaatggtccacagggaagagggtacataggaaggtttggtggtgtggcaggatggtatcttccaggaatgagctacactggcagtggtaggggggagaaaggaagggtggatggtgaggggtcatggtttcttccaagaatgactcataggattgtacaggaatgacccagaggggtagcgcagagagaggaaacatgactggtgtggcaggatataccttccaggaatggtctacaggagctaggggatgcagggaagatgggcttgtttgcaggcatggttcttcctggagtaacccaaagggtcaggggtgagacagcaagggtggatattgggccgcggataacttccagcaatgaccaaaagagatgggaggagacaggaagtgtggaaggtgaccaggatggtatttccaggaatgaccctcaagagttgggagagacaagtaggatagatgatttgatggagtggtatcttccaggaatgaaccaaaggggcagaagaaaacatggtacattgtgtttagagagatggaatcttccaggaatgagttaccctggtggtgttttcggggacatggaaagggtggggatagtatcttccaggatgacccacaaggccaaggggggagacaggacagggtggatactgtgtttgtagggggagggcatgttacttctcagggatgtgacacaggcactgtggggacacagagaagggtagatgttttgtggaggaggtggtctcatcccgaaatgacccagagggtttagaaaggtgtagcaggatggtatcttccaggaatgagccacacggttggtggcgggggaagatgggtggtatagagagatggtatcttccaggaatgacccacaggggcaagggggtgacctgaagggtaaaggttgtgaagggggatatcttccagtaatcacccaaaggggtagggggagataggaagaaaagatagtgaggcaggatgatattttctaagaatggtcttcagaatgtgtggggttaagtaaacaggaaaggtggatggtgtaggaagatcgtatcttccaggaatgagccaccgaggttggggtgagacaggtaggtggatggttttgtagaatggtattttccaggaatgagccacagggcagggggtagatataaaggatggatggtatgggggagatggtatcttccaggaatgaactacaaaattgaggaaggaggggaatgatggatgagctaggtggatgggatctgccaggatggcccacagagccaaaagaaagacaaggcagagtggataatgtaggggaaatagtatcttccaggaatatcacacaggcaatgcagggaggcaggaaagggtagatgttttggtgagggagtggtatcatccccaaatgacccagagtggtagaggggagataggatagttgaatgacaggatagtatcttccaggaatgagccacggtgacagtggtgggggtgggagacagtaagagtgtatgtggatggtatcttccacgaatgacccacagaagtcagggaaataagtttaggcaaatggtatctcctaggaatgtgccaaaagggtagtggtggggggagatgggaatggtggatattgtggaagtgatatcatacaggaatgagccagagggggtagtgaggagtcaggaatcatgaatggtgtggcaggatatattttcaaggaatgacccacatgggctaaggggacacagggaatgttggcctgactggggacatggtatcttcctggagtgactcaaagggttgggggaagataagaagggtggatgttgtggggaatacattccaacaatgacacagaaggatggggcgagacacaaagtggttaaggtgaggcaggatggtattttccaggtatgacccacaaggttgggagagtaagaaagatgagtgatggtggggggaaatggtatcttccaggataaccctcaggggtaagggtaaacaggacaaggtggatagtgttgaaggggttatatctttcaggaatgtgactaagtctctggggggaaacagggaagggtagatgttttgtgagggagtgataccaaaatgacccagaggaatagtagggaaataggacagttgcatggcatgtcaggatggtatcttccagaaatgagtcacactggtggtggcggaaagagacaagaaaggtggatgttatcattcaagatgatatcattcaagaattacccagaggaataggggagagacaggaagcctgactggtgtggcagggtatattttctgggaatgagccacaggtgtgggagaagacagtcagggtagatggtttggtggaatgaaatcttccaggaatgacccacagggtcatgggggaaaattgaagggtagacattgtggatggagatatcttccagcaatgacccagagggatgggggagacaggaaatgataatggtgcagcaggatggtatcctccaggattgagccacactggtggggttgtgggggtcatggtatcttccatgaatgacccactggggtcgagggaagactggtagggtagatggtttggcggaatgttattttacaggaatgacccacagggcagaaggtagataggaaggatggatacagtagaagagatggtatgttccagtaatgagctatagaatttggggagggggggaatgatggatgaggtagggagatggtatcttccaggatgacccacagagccaagggggagacaaggcagactgtataatataaggggtatagtatctttcaggagtgtgaaccaagcactgcaaggaggcagggaagggtagatgttttaggaagaaggtggtatcatcccaagataaccaagaggataacaggaaaatagaatggttagatggtgtggcaggatggtatcttccagaaatgagccaaatgacagtggtgggggtggcagaaggtatgggtggatggtatcttccaagaatgattcacagaggcagggggtggcagaaggtatgggtggatggtatcttccaagaatgattcacagaggcagggggagacagggtacattgggtttagagagatggtgtcttccaggaatgagacacctgggtagtagtgggggagacagggtacattgggtttagagagatggtgtcttccagtaatgagacacctgggtagtagtgggggaaaacaggaagggttgaagtgtggggggatgatatcatcctggaatgagccagaggattagtgttgggggggttatatcaggaatgtgacaaaggctctgcggggaaacagggaagcctagatgttttagggacggtgtggtatcaccccgaaatgatcagaggggtagtggggagatacaacggttgcatggcgtggcaggatggtatcttccaggaatgagtcacactatgggtggtgggggagaccatcagggggatgttggctggcatggtatcgttgtggaatgacccagagggacagggcagagagagaaagcatgaatggtgtggcaggatatattttccaggaatgagtcacaggggcagtagggaaacatgaagagtagatggtgaggtgggatggtaccgcccaggaatggtccacaggagctaggggatgcagagaacattggcttgttggcaggcatggtttttcctgtagtgacccaaagggttgggagtggtgggggagataacttccatccacgacccagaggagagggagtagacaggaagtgtggaagatgaccacgatggtatcttccagggatgacccaaaggggcagagggacacagggtggattgtgttttgagagatggtgtcttctaggaatgagccaccctggtggtgcctggggggacacaggaagaggtatgtggagatggcatcttcctggatgacccaaaggggaaagggggagacaaggcaaggtggaagtgttgggggaggtgtgacagtatctttcaggaatgtggtatagtcactgtggggaaacagggaaggctagatgtggttatatcatctcgaaatgacccagaggggtagagggaaataggaaggttgcatggtgtggcaagatggtatcttccaggaatgaggcacactggcagtagtgggggtggagacaggatggaaggtggatgtggatggtattttcctggtgtgacccgcaggggcagtaggtaacagtggattgggtttagagagatggtgtcttccagcaatctgccacaagggtggttagaggtccgggggataccggaagggtggatggtgtagcaggatggtatcttccaggaataaaccctggcaggtgggtgttttgggggaattgtgtcttccaggaatggaccataggggtagatgggagacaggtagggtatgacagaatgatattttccaggcatgacccacagggcaggggatagagaagaaggatgaatgttgcattggagatggtatcttccaggaatgaactacggaattggggaagcgggggaatgatggatgacgtaggggaatgggatcttccaggatggctcagagatcccagagggagtcaaggcagggtaaataatgtaagaggggatagtatctttcaggaatatgacacaggcactatagggtagacgttttggggaggaggcggtatcatcctgaaatgacccggaggggtagtggggaaacaggaaggttggattgtgtggcaggatggtatcttccaggaatgaaccacactggtggtgcttcgagggggacacaggaccggggatgttatctaacaaaatgactgacagggaagagtagatagttctgtgtaggggtatagtatctttcaggaacgtgacacaggcactgcggggagacagggaagggtagatgtcttagggagtgggtggtatcatccagatatgactcaggagtaggggggaaatagaaaggttggatggtgtggcaatatggtatcttccaggaatgaaccacacaggtggtgactgggggaggcaggaaaggtgggtggtgttaggggatggtgtcttctaggaatgacctacaggagaagggggagacagggtggattggctttggagagggccacaggtgcggtggctggggagacaagaagggcagatggtgtggaaggatggtatcttccagaaacaacccacagggatacagggagacaggggtttagagagatggtatcttccaggaatgagccacatgggaagtggtagggagagacaggaaggatggacgttgtggggggtggtattcgggaatgacatagctgggaatgggggaaacaggaaacaggaatgctgtagcaagatacatcttccaggaatgagccacgagggcttgaggggagacattatgattggatagtgttggtacatggtatattcaaggaattagccataggtttagaggggagacagcaagagtagatggtgtagagaggatgatatctgcctctaatggcccacaggtgcacgggggagataggggagattagatagtgttgggggaattatatcttccgggaatgtgacacaggctctggaagagatggtgaaggtggaatttggttgtggggtgggggaggggggaggtaatgatatccccaaatcacccatagtattagggtggcaataggaagattggatggtgtaggcagatggtatctactaggaatgactttcagagtcagtggggacatgtgaagatagaaaatgtgtttgcagagatactgtcttctaggaatgagacacacttgctgaggggaggcagggaagggtgtatgttttgggggcaatggtgccatccagaaatgaaccagaggagtaggggatagacaggaagagtcaatggtatgtggcaggatgctaccttccagaaatgacccacaggtatgtggggagataggaaaggttggatgatgtgggaagaatggtatctttcaagaatgactcaaagttctcaggggaatggggagacagggacgggtagatgatgtacagtgatggaatcttctaggcatagaggacagggacaagcttttgtgaaggccttgaggtgagaaggatattggcatgtttgagcaactgagtggacagtgtagctggaccatagtgatgacaagagcaagtggtataaggggagtttgcaggactggtctagaggctgatagtgcaggatctatgggccacattgaatatttgtcctttctccactgaagatcgttgaaaggttttaagcagagggttttttgagtttggcacttttaaaagccctcattggctatagtgtggaggatacaagaggagatgcaagatgaccaagtaggagccaccactgctatagcctggacatattggtagcctggaccagggctgtggcaatgaagatggagaggagaagatgggtattgaaagaagcttattgatgcttagagagaacctggattagcatacttggagctaactcataatttctttttttttttttaattatactttaagtgctggggtacatgtgtacaacatgcaggtttgttacataggtatccatgtgccatgttggtttgctacacccatcaactcgtcatttacattaggcatttctcctaatgctatccctccctgagccccccatcccctgacaggccctggtgtgtgatgttcccctccctgtgtccatgtgttctcgttgttcaactctcacttatgagtgagaacatgcggtgtttggttttctcttattgtgttactttgctgagaatgatggtttccagtttcatccacgtccctgcaaaggacatgaactcatcctttttttatggctgcatagtattccatggtgtatatgtgccacattttcttcatccagtctattattgatgggcatttgggttggttccaagactttgctattgttaacagtgctgcaataaacatatgtgtgcatgtgtctttatagtagaatgatttataattctttgggtatatacccagtaatgggattactgtgtcaaatggtatttctagttccagatccttgaggaatcaccatactgtcttccataatggttgaactaattgacactcccaccaacattgtaaaagcgttcctatttctccacatcctctccagcatctgttgtttcctgactttttaatggttgccattctaactgtcatgagatggtatctattgtggttttgatttgcatttctctaatgaccagtgatgatgaacattttttcataagttttttggctgcataaatgtcttcttttgagaagtgtctgttcatatcctttgcccattttttgatagggttgtttctttcttgtaaatttgtttaggttcgttgtagattctggatattagccctttgtcagatgggtagattacaaaaattttctcccattctgtaggctgcctgttaattctgataataatttattttgctgtgccaaagctctttagtttaattagatcccatttgtctgttttggcttttgttgctattgcttttggtgttttagttatgaagtctttgtccatccctatgtcctgaatggtattgcctaggttttcttctagggtttttatggttttaagttatacgtttaaatctttaatccatctcgagttaattttcgtataaagtgtaaggaagggatccaatttcagctttctgcatatggctagccagttttcccagcactatttattaaatagggaatcctttccctgttgcttgtttttgtcagtttgtcaaagatcaaatggttgtagatgtgtggtgttatttctgaggcctctgttctgttccattggtctatatatatctgttttggtaccagtaccatgctgttttggttactgtaaccttgtagtatagtttgaagtcaggtaacgtgatgcctccagctttgtcctttttgcttaggattgtcttggctatgcgggctctttttttggttccatatgaagtttaaagtagttttttccaattctgtgaagaaagtcagtggtagcttgatggggatagcactgaatctataaattactttgggcagtatggccattttcgtgatattgattcttcctatccatgagcatggaatgttcttccatttgtttgtgccctcttttattgcgttgagaagtggtttgtagttctccttaaagaggtccttcacatcccttataaattggattcgtaggtatgttattctctttgtagcaattgtgaataggagttcactcatgatttggctctctgtctgttattggtgtataggaatgcttgtgatttttgcacattgattttgtatcctgagactttgctgaagttgcttatcaacttaaggagattttgggctgagacgatggggctttctaaatatataatcatgtcatctgcaaacagagacagtttgacttcctctcttcctaattgaatacctttatttctttctcttgtgtgattggcctggtcagaacttccaatactatgttgaataggagtggtgagagagggcatccttgtgccagttttcaaagggaatgcttccagtttttgctcattcagtatgatattggctgtgggtttgtcataaatagctcttattattttgagatacgttccatcaatacctagtttatggagagtttttagcatgaagggctgttgaattttgtccaaggccttttctgcatctattgagataatcttgtggtttttgtcattggttctgtttatgtgacggattacgtttattgatttgtatatgttgaaccagccttgcatcccaggaaggaagctgacttgatcttggtggatacgctttttgatgtgctgctggatttggtttgctagtattttattgaggattttcgcatcaatgttcatcagggatattggcctgaaattctctttttttgttgtgtctctgccaggttttggtatcaggatgatgctggcctcataaaatgagttagggaggatcccctctttttctattgattggaatagtttcagaaggaatggtaccagctcctccttgtacctctggtagaattcagctgtgaatccatctggtcctagattttttttgttggtaggctattaattactgcctcaatttcagaacctgttattggtctattcagagattcaacttcttcctggtttagtcttgggagggtgtatgtgtccaggaatttatccatttcttctagattttctagtttatttgcatagaggtgtttatagtattctctgttggtagtttgtatttctatgggattggtggtgatatcccctttttctttttttattgtgtatatttgattcttctctcttttctttattagtcttgctagtggtctattttgttgatcttttcaaaaaaccagctcctggattcactgatatttttgaagggttttttgtgtctctgtctccttcagttctgctctgatcttagttatttcttgtcttctgctagcttttgaatttgtttgctcttgcttctctagttcttttaattgtgatattagggtgtcagttttagatcttccctgctttctcttttgggcatttagtgctataaattttcttctacacactgctttaaatgtgtcccagagattctggtacgttgtgtctttgttctcattcgtttcaaagaacatctttatttctgtcttcattttgttaattactcagtagtcattcaagagcaggttgttcagtttccaagtagttgtgcggttttgagtgagtttcttcatcctgagttctaatttgattgcactgtggtctgacagacagttcgttgtgatttctgtacttttacatttgctgaggagtgttttacttccaattatgtggtcattttagagtaagtgtgatgtggtactgagaagaatgtatactctcttgatttggggtggagagttctgtagatgtctgttaggtccacttggtccagagctgaattcaagtcctgaatatccttgttaatttttgtcttgttgatctaatgctgacagtggggtattaaagtctcccaccgttattgtgtgggagtctaagtctctttgtaggtctctaagaacttgctttacgaacctggatgttcctgtattgggtgcatatgtatttaggatagttagctcttctcgttgcattgatccctttacagttatgtaatgcccttctttgtctcttttgacctttgttcgtttaaagtctgttttatcagagactaagattacaacccctgctttttttttttgctttccatctggttggtaaatattcctccatccctttattttgagcctatgtgtgtctttgcatgtgagatgggtcttccaaatacagcacaccgatgggtcttgactctttagccagtttgccagtctgtgtcttttaattggggcatttagcccatttacatttaaggttgatattgttatgtgtgaatttgatcctatcattttgatgctagctggttatttttcccgctagttgatgcagtttcttcatagcatcaatggtctttacaatttggcatgtttttgcagtggctggtactggttgtcctttccatgtttagtgcttccttcaggagctcttgcaaggcaggcctggtggtaacaaaatctctcagcatttgcttgtctgtaaaggattttatttctccttcatttatgaaacttagtttggctggatatgaaattctgggttgaaaattcttttctttaagaatgttgaatattggcccccactctcttctggcttgtagggtttctgctgagagatctgctgttagtctgatgggtcttcctttgtgggtaactcgacctttctgtctggctgcccttaacatttttttccttcatttcaaccttggtgaatctgacaattatgtgtcttggggttgctcttttcgaggaatatctttgtgatgttttctgtatttcctgaatttgaatgttggcctgccttgctaggttagggaaattctcctggataatattctgaagagtgttttccaagttggttccattctccctgtcaatttcaggtataccaatcaaacatagatttggtcttttcacatagtcccgtatttcttggaggctttgtttgtttcttttcactcttttttctctaatcttgtcttctcgctttatttcattaagttgatcttcaattactgatatcctttcctccacttgatcgattcggctgttgaaacttgtgtctgcttcacgaagttcttgtggtgcatttttcagctccatcaggtcatttatgttcttctctacactggttattctagttagcaattcgtctaaccttttttcaaggttcttagcttccttgcattgggttagaacctgctcctttagctcggagtagtttgttattacccaccttctgaagcctacttctgtcaattcatcaaactcattctctgttcagttttgttcccgtgctggcgaggagttgtgatcctttggaagagaagaggcgttctggtttttggaatttttcagcctttctgcactggtttctccccacctttgtggttttatctacctttggtctttgatgttggtgacctatggatggggtttctgtgtggatgtcctttttgttgatgttgatgctattcctttctgcttgttagttttccttctaacaggcccctcagctgcaagtctgttggagtttgctggaggtccactccagatgctgtttgctggggtatcaccagcagaggctacagaacagcaactattgctgcctgatccttcctctggaagctttgtcccaggggggcacccaccagatgccagccagagctctcctgtatgaggtgtctgttggcccctactgggaggtgtctctcagtcaggctacacgggggtcggggcccacttgaggcagtctgtccgttatcagagctcaaacactgtgctgggagaaccactgctctcttcagagctgtcaggcagggacatttaagtctgctgaagctgcacccccagctgccccttcccccaggtgctctggcccaaggagatgggggttttatctataagtccctgactggggctgctgccttttgttcagagatgccctgcccacagaggtggaatctagagaggcagtaggccttgctgagctgtggtggggtccgcccagttcgaacttcctggtggctttgtttacactgtgagcataaaactgcctactcaagcctcagcaatggcagatgcacctctccacaccaagctcgagcattccaggtcgatatcaggctgctgtgctagcagcgaggatttcaagccaatggatattagcttgctgggctccatgggtgtgggacccactgagccaggcaccggagggaatctcctgatctgccagttgtgaagactgtgggaaaagcgcagtatctgcgcaagagtgtaccgttcttcctgggacagtctctcacagcttcccttggctaggaaaaggaaatcccccaaccgcttgcacttcccaggtgaggcgatgccctgccctgcttcggcttgccctccatgagctgcacccactgtccaaccagtcccaatgagatgaaccaggtacctcagttggaaacacagaaatcacccaccttctgcgcggatctcactgggagctgcagaccggagctgtttctgtttggctgtcttgctggacccttggctccttttcaactcataatttcttaagcaggagaaaatgttagtttctccaagagttaaagaatgcattccttcagaaattgaatccttgagagtttttttcaattgcaacagaaaaactttctgaacacactaaatcgtgttgtaaaaacatgacattctctgactcctgtacatattgacacctgacttccacttttgttctatgaacaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggtatggtgtgtatgtgtctgttctgaaacaagagcttcatctgtgattttgctttctcccagggcagtgtctttaatagttgcttcaggattttgaaacatgaataattagcagcatgaaatgatctcaaaagattttctgaaaaaaaaatttctcatttccttttgtcactcctgaaaaggagttcacagataaagaatgtttcattttgaattaattaggttttgagaattaagttccttccttttggtagcaggtaaaattaggctgtttatgtaggagaagctaaattcctaaaataatttccaaaaaattctagaaattgtacaattattgtacttaaaatcatctctgttctagacacaaggtttctgtcccatctgtttatcagagtgattcttttatgttaactgctacagaagggaagtgactgttcttccttctaattcacgcaagtgattatggccactcttgcaatagtaaattctgccttttggattcttagtttttgctacccacttgaatttgcccagtttccatatcatttcctttattaataagtgaattcatttcgttcattggctggacacatggcgaagccagaatcctaattccccagactctgagattctctgcttcaaccctttctgttatccaaagagaatgggtatctctgttctataaatgttgtgcttggatggtatgaggtttaattagtagcagtttacttctaacttaggttctctgagttcctgaattctgagtgcacagtacaaggtatagagtctttctctgccaagtgaattattcttctcctgaggagatcaccggaaatccccaagttcttgtgacaccaagactcattgcccatttgacccttagccttgacaaatgcaggacagttgcattttttaaatgtctttacctacaggcagagatgacagattactccttttagccagtattttactttctgaggtattttgatttacatttgatatttgtttccttcattcagaggagccaggatacttctagccaaattctacatgaccttttggaaaatatggttcagatgattaatctcaaaccatggtcacaatatttttataaagaacttaggcttatcctgtaatttaattcaacaaatactagacctggaggggtggacagtgaacaagacagaaacagttcgtggtctttccaccacactaaaactcaaagtacctcttagaaaacagaccagattataagttaaatggtctgggtttcttgaggaaagacaaatcatgaatttaggtctgaaccactctgggaattttttttcctttttttaatttaatttttgagacagagtcttgctttgttgcctagcctggtctccaactcctgggctcaagcagtccttccgcctcagcctctcaaagtgctaagatcacaggcatgagccaccatgcctagccaggaatattttttataaagaactttggtgttgttattaaaacagtagccagttacaaaagtgcaaaaatcactgcgtggctgcttatgcagttttctggaggagtatgattgaggaatctgttaggaatcttctggctgggcgcggtggctcacacctgtaatcccagcacttttggaggccaaggagggtggatcacctgaggacaggagtttgagaccagcctggctaacatgatgaaaccccatttctgctaaaaatacaaaaattagccaggtgtcatggcacgcacctgtaatcccagctactcgggaggccaaggcaagagaatcacttgaacccaggaggcggaagttacagtgagccaagattgcgccattgcatgccagcttgggcaataagagtgaaactccgtctcaaaaaaaaaaaaaaaaaaagaatcttctataataggctaaaaatatccttctggttcttaccaaaagcattgtgttaaggacttaccttcttagattaagctggaaacatttccatggtgatcgtagcagaaggcagagggtagagcacttctggtcttataagggccgctcaagagaactatttaacaatatctaaaggagcaagcagatgcttagccttcaccctctgcctctgccttgaagcttccagatagttttgcaaaaagttactcaagatctgatattccgaatcttttttttttttttttttttttgagacggagtctagctctgttgcccacgctggagtgcagtggtgcaatctcggctcactgcaacctccgcctcctgggttcaagtggttctcctgcctcagcctcccgaatagctgggattacaggcacgtgccaccacgcctggctaatttttgtaattttagtacagccacagcacccggcccttcttcccattcttagaacatcatttggtggtgactagtaggactagtaggacgtgactatccctaaaagcaccctgtaactttgtctataatatggctctatctgcatccttacctgcctggacaacctcagcccagaacacaggaatcaaaggaaattagaaacttcatcctctggaataagccctgtgcctgccccttctcagggctccctccacaccctgcactctttgacatttgaagcccacagacttgctgatattccccttggtcagggcagcattggcatagtggaacatttcttcgggttctgtgatttttataaacttgtaatggcttttctttgccagaagctgtgcagggaatgatcattgaattgtcttggtcaactctgcctctgtcctaatgaagtcttctgacagttaagtgtgcagacgttagaggtgtggcctgtgactttctggaggttttctaatcagtagccagtaggattttccttccttgggctttcataatgtttcctttcttacctacctcctcctgtaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgaggtaactcagtttagtcaaaaggagcatatagtaaataggccttgtgtcttttgcagtttctaaccagatataattcaagcagtagcataattaatgctgacatgtttccgcctcagtcttccaaattaccagccttggttgacctaccttgatctgttttgttgcctcacagttgcctcattttctcattttgtatgtttttactgctcaatgttgtttagaagtgataaagatgatttttcacgcctgccacaaagactgcagctcacatttgaggtaatattttgcttgtgtgtgttttagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaagggtaggctgctattattcatgtttaaactgtattatatgaagaaatcacagtcttttaggattattgaacagaaggtattgaacagaaacaaagtattttcaaactggtagaaaaaggattagaaatcttggtctgtcaatttcctcatatccttggccacacataatgaccccaagagcacttgttggcaatgggagggaagaaggagatcacatcagtcataaggccaccattgccctgactcctggcatctgtcctgcttcttactttttatgagcagagtgaggtcaacaggcaccatggaaagagcactgcgttgaagttacacattccgggacttcgcttgcttgctagcatcagtctgtagctgtaaagtggtgacagtaatacctaccactacggtgttgtgagaattaaatgaggcaggatcttggacttagaaagctgcccagatatggtggctactgttgataagcattctggttatactcatcggattccctcctcccacctcttccctggattgggtcattccctccaatgcagcccttctctttcctcatgtatgctaggagccagggttatcttaccatttttgtcatgcattggctggtcataagccctttatgtaaaggtgatggagatgggtcattttctgtctgtgggtgaatagacatccttatatattcagtgtgtgtatttaacaagacatgtagggttggggccaagaccaagagtttaagtttttacttcctcttaaaaaatagtttatatatatttatgtgtgtatgggtgtctctgatgagcttgatctcgatctcccattgatttttctcctggttaagattactgtggctgcatgatcattgaagatgaagatgctccaatttcaataaccttggatgacaccaagccagatgggtcactgcctgccatcatggggtaggttagagcagggtgttctgcattttccaaattgtgttgatgtattggtgtggatgctgtcaaagtatattactttggaattaagttcaagcaatgatgaataatgctatcaaaatatataatgtttccatgtgttaaaatattgcagtaatgtttcgtatgtagcacaagaatactgggaaactttactaaaattgacaccattttgaacttgtacccatgtatgtctttctctcatacaaagcttacgtgttgaggatggagtgaaaaaaagcagctagacaggcagtatggtagccacccctgcctacaggcagaatgtccacagccattctgaaatgagaactaaccgctttattctataaaaacattctaaatgtggggtttctcggttttatccttttctccattccagatatctgctacatagcaaatgttagttgttaccctgagatataagacagctgaccaattaggaggcccagttcagaattgagccaggccttgattggatggcatggcagtttttctggtgggtcactctagttatccttcaccagtggtgcttcacttaacctctaaagtgtgcggatgacccagggcctggttctgtgtagggaaaatgagagcttttcccctctcttctcattccggcacatagctgtcctactcgttgggggctggggagtccagagaaggaagtggtgtccccacaaatgaattgctaaggagttccacagcctccctcttgcctgccttttggcctcctcaaaaactatacaaataaaaggcgatttattctaccacactgtaacaaaagaacatagcttcagtagcaatcaagtgacttttagagaccagtggtctcccctttacccctaggaaatgcatagctcttgctcagagggaaaggtgaactcatgcacatcatgtcattgaaggaaaattacaaaggcaaaaggagcagacccacatcccagggaagttagaaagcaggttgtgctgctggttactaatgagacattttataaccacttctctcattgtaacatataagaacaccagcctccctgagaaaggcaggtgcttacaacataatgactgttggaataacacatcctcttcatctctaaccctattgggcagaagaggatataggttgtttgggtagtttgacatcatcttctatatgccagagaaaagcaggaggttcaggtacaggtttcaggagaatgtcggttaagacaaatccaactatgaatggaagagcaattgatatttttcttgccctgggagttagatatagtgatgtcttctgctgtttttgggctttctttttttttttttttttttggaagtggaactcaatattttaatgattttacttaagataaatagtataaaaggaaaatgttaaacggttgtgttctgtggacagtggggctaaaacaaatataaaataataataattggttatagaggaccaagtacagaagatgagagtttccttggaaactggggaataccaaaataatctgtttcttaacttggcgatgtagtcttaaaaattaaagctaccatttattgagcattggttgtgggtgcaagtttttatgtgtacaatgcttttgggctttcttcagctttattattaactaggttagggctcaaataaccttccaggtgttaatggagttatttaggcaattcttagaaagtgatattctaatctctttcatcttgacacttgcctccaccctgctctttgctgatggccacagccacgaaaaccttgaagataggggtggtaattgcccagcactgtgtttgtaataaacttttggaaactagaaaggaccttgtactttagaactgtgaaatgtttccaacacaaagccagcatgtttaatttcctcaataaaacaccaaagtaagttaaagcttatttatccatagttgggattagatcaaagagattatttcattcatgacttgagatttgacagaaataaccaacactaactgccctttgggaagggaactgtaaaaagtatacaagacaagttgactaaaaatgttttcagataaatcatttaatcttttatcagatattgatgattaaaaaaaactatatacatctaaacttactgattcttgcataaacccagaatctaactaaaataattaataacaagctataacttgaggtgttaaatcatgcaaaattatgactatatcccataaagttcaatagttcagatttcctaaatagtccacagctttctctgaaatactattctctacattaacatacatctttgcttctcaaagtgatctcaaataacagccctaaaggaactgccaatccaatttgaggaacactttaatttgtgggtagggagaggaggaaatatctgttttttgcactgatctacctgtccttttggtcttgaataaaagaaatacaaatttaaaaattttttaatggaaaaataatttcattgtcctttagctcatttggatttttgaaagctttctaataatagtataactaaggacttcatgtcacaattcaattcttttaaatatacatgcagttagtaatatcagtataataaatagaatatatttgattaaaggggagcaggcaggttataactgagttttattgagttactttatttggggactatattaggtcagtttccagggaagctgactcagagctggagatctgggtgctggaactttattgggaagtgctctggggatgactacctatggcagaaggattatgcggaacttgagctccaatgttgtcccaacaaaggcctctgccattcccttggaagttctggagctgggtggcccttcagagttgtcttcaaccgcatctaggtcagaacaactctagggaggggtgggaccttgagcgaggcattctctgctgccccgtccaattactggggaaggtttcagctgtgaggtaagagtaacgagtgcctggtcccaaagggagcctggggggcccaccgtggcctccactacagacacatgtttatatttgtttttccagctttgataaagtatttggcagaaggcaacagtcattaccagaataatcatttagcacaacattcattcattcaacatttgatttcctactatatgccaaaaaccatgttaaactttagaagtaaaatattgaataggaggtcacctgtcgtgtaggggatcacagcctagcaggggttttggacacacaggcagaccaaagacaatatggcatttgccctactagaggaggagggtctgagagagttcatttcatgctgaatagctacaggttaagaatacttcagaaagaaagggcagctcttaaaataaacagctgtaacctgatcattcaatgtaacctctctctccagcttcattcttgcccggaaagctgatcgacttgctaagctacat

SEQ ID NO: 940 - DNA, 152 bp, mus musculus; identical to SEQ ID NO: 136

SEQ ID NO: 941 - DNA, 28366 bp, mus musculus
ggctcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgcctcggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccaaggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaataggtatatattggtttatttgttttcagcaaagggtagatgtgtttgaggtttttttaagttatcgttttctgattataaaagtaatgagcctaattggaaaataagtcttttaattaacagcacttggaaatggtagccaaaatagaacaatttttttttaaaagaaatctctgtacatagaataccaagaaggaaatatctgagaccaagaaataaagcagaggcggaaagccatgtccaggtggcttgggggatgggcatcagatccagcaagagcctggtggcttgggttttaatactcacctggaaacccccataaagaagggagttaaagccaggcacggtgatgtatgcctgtaatcctagcaccttgggaagccgaggcgggagaatcacttgagcccaggtgctccaggctgcagagagctatgatcacaccactgcactccagcctgggtaacagagtgagaccctgactctaaaaaaaaaaaaaagaagaagaagaagaagagaagagggctgaaggccagatttctagccaaaagccagggggaaagcccatctttacctcggcctttggtttaggggaggaaatagtcacctatgagaagtcaaaccacgagcctgtgccacattcagatgtggagtggaatgcacacgaaaatgtgctccaggctgcagagcccctgcagagggagaatttcacaatcctagctgctcggtgagtgctccctgctcaacctgacccgatgcctgatccaaagttagaaaaccaagagaacacagtccacgcaggcccagcatgtgcagacaacagggcagcaggcagccaatacttggggataagataataattactggactatcaaataagtaagtttaaaaggaaactgaggtgaaggagagttaacaacaacctggtcgtaacagtacggcagtgatgaggcacccagtggtgtgagaacgtggtactaagtagcacctctgaagggcttcacagagatactcgaggcgttaacaagcaatcagggtacagggtgttcagaatcaaggatgagcacaataagagaatgctgcaagctgaggcttggtgacccaatgaccttgtagagctttgcagatgctatctgggaagaaaaaaagctgggaagggagttttattgtgtaggtagagacctccataagggagaagtaggagagacttctaccccccagtccagtgaggaagcaaggaagctctaaatgtgcactaatagaggagtgatgagagtgacaagtgatcagcctttggaatgtctgacatcaaaagcctgtccctcatttggcaccctcatctgcctgcagcccagctgaggacctaggatctaacacaaaagcttagaagtagcccagaaagttgtcttaacactcttgcagggaaacacaggccctgattcttagaagagccttgttcattctgctcaaagctgccttccaacggctgctggggttcccagcacagaagagaaggaacggaccatgcagctggagatcggcctctgccagcagcaggaagtggctgtggccagggaggagacacaaatatataaaagacgggagcagaaagttaacttgcaaagaccctaggtgggcagtcacggggtggagggcagcgctgtgtcacgtagcctattactgtacggtgtgtaatgttcacaaaaatgcccttggccaagaatcaaggttgaatgacgctgagagtcctctgcaaaagattgtgagcaacattttggagtcatatctactagaaatgcttgcagttgacttggaaacttctgcaagtcacatggaatctgcattcaaatgaggcaaatgcactggcccagtggaaggttagaggcaaagaatccagccaaaggggtacaggagcgagcgtcagatgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgcctgtaattccagctattcaggaagctgaggcaggagaatcacttgaacctgggaggtggaggttgcagtgagccgagatcacgccactgcactccagcgtgggtgacagggcgagagtccgtctcaaaaaagaaaaagaaaataccaaaaaactccaaatacgtacagtttacccatttaaagtgtacagttcagcagtgttttgcatattcagagatttgtgcaaccatcactatctaattccagagcatttttatcaccccaaaaagaaaccctgtacccattagcagtcactccccatttacttccccccaccttatccctggcagccaggaatctactttctatctttatggggttatcttttggagactttgtatatcaattggtagtatagaacatggcctttgtgtctggcagatacctttgtaaaccagaaaatgttattttggcagctactcagcccaaagaatagtagattccacaaatttgtatgaccatctttctttcctcccccaaccttgtttttatatacatagtctaagaatatcatacatgctcttagcagaaattcagacagtacaaaagtgtcccatccctgttctttaaatgccaccgttatttccagtgtcagaattgtgttatttaagcgtatatctgcctatttatttcacgcaaatggcaatgcgatgtacacagttcttcactgtgcttttctgaaaaactcacttgctgtatcttaacaatgattccatagtcgtgttgtgcagctgtgcaatattcccttgtgtgcatgtaccacagctcctgtgaccagtcaggccccctcttccccatttgtaggtgccgttgtttgcactcttaaatgcagttgtgaagcaatatcgttgctttgacattttgtacacgtgtgctagtaggatacgttcctagaagtggaattgccgagtcaaaaggcatgagccattttaggtttgatgggcagtgccaaaatatggtcttttccaaaaaatataccagttgacattccatcatgtatggatgccagtgactttctacacagccttgctcacacagtgggttatcaggcagtttacttccagatcaggtaggtgatctatggcatcctcttcctgtgagctctggttgctgtgggtgagggtagtgccctcaccagggtatgttgattttccatgagatgggtctctattcaaatcttttgcctattgttctcttggctgggacgtttcttgtggattgtctacagttttgcatagacgagatcacagctgtttctcatgtgtgttgcaaatatttctccaagttttttcatttcttctcctattttgtatttttattctctgcaggactttaaaaaccttcttacgtagtcaggtttattttttcttcacattatggcttctgagtttatgtaggagtcatccttctcttaaaatttgtcttctcccatgattctgtatatttttttcttttttaatgtcccaagtttacttccatctgaaatttattttggaataaagaatgaaataagaatccagcccccccacccccgactctactgtctagtttttccaaaactatttattaaataatccacctctattgatttgaaatggcatctttcatcatatacagagttccccatttcaaatagatagctatttgccaactcctacttttaaaaaaatgcagaataaagtaaacagaataaatggctggggttgagatgctgttttgttttgttgagacctcctttcaagcagtctgcactcaatcacccctgctccctctgccaggaaaatcaagctttttagggaagtacatttcagaatttttgtcacctcctttctcttttccaagtgtttctgctacacattattgtcatcctcatattctagcccccaactgacagtctcctcagaacagccttgcgggtaatacatgacatatgcagttgacattatctgtgacttctttgcttgatgcaaaaggtcatagttagcaaaataaaatactgtaaatttctgtctgaccaattggagcttgttgctttagaaaaagctttgaagcttgactcgttccgggtaaaactgaatgttgccacaggaggtcactcttgggtaggctttgtagcttggttgggttgaccacggaaagaaaattaaacctaagaaacctacctaccactgctgagatagcaagtgtcaacctaaaagtggtatgggaagagggtaaaactagataactcagatttaactttttttctgattacataatctttgaagatgctctataggaaatttggaaagtagaaagaagaaaatcttaacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctccatgatatacaaggaaaagaagagttacctatagctttttcaggaaatcatagcgttctaacaacccaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgctttaacttctccggtatagaacttccaccacaaagggcagtgcttcccagtgctgggctgtggattggtatcctgtcatgcccaaatctgcctagtcgttaccaaataagcagacggtaatgtatgtggacattttgtgcgaggtgttcatgtgtcttgggaaaacctgtctcatgttcccagaaagtagctttccttacctggagtttgagtggcttttatgacattggcatgtagataatagaactgtacgtgtttttttgtttgtttgttttttgagatggagtctcgctcagtcgcccaggctggagtgcaatggcgtgatcttggctcactgcaacctccacctcccgggatcaagcgattctcccgcctcagcctcccaagtagctggggttacaggcagccaccatcatgcccggctactttttgtatttttgtagagatggagtttcaccatgttggccaggctcatcttgaactcctaacctcaggtgatccacccacctcggcctcccaaagtgctgggattacagctgtgagccaccgtgcctggctgaactgtaggtgttttaaggtgatgatggagcaaaatttttgttggcctttaaattaatttttttaattaaatctttaagtaaggaaactgttgacagctagacaagtttacaaacaaagggtatctgctagggctactgtggttttggttgcatcctgaagaatgagtgttttaagggtaggatgagtgttctaagggtaggagaaacatggacctcaatatagtaatgattccctttgcttcaaggacgttgatgtcttattctcttatctcacagtctctgtgtttaactggaaagtttggtcccttttcttttatgataattgacatagttggatttatgaccaccaccttactatgtggtttttttgtttttgagacagagtcttgctctgttgcccaggctggagtgtagtggcgcgatcacagctcactgcagcccccgatctcccaggctcaagtaatcctgccaccttagcctcccaagtagctggaactaaaggcgcatgccaccatgcctggctaatttttgtattttttgtagagatggggttttactatgttgcccaggctggtctccaattcctgggctcaagtgatctgcctgcctcggcctcccaaaatgctgggattataggtgtgagccaccatgcttagctactatatgctttagtttttccttctccacaaagtagacattattattattttggttttgtacaatcaacatttgtttagatttgtccacatattgatcaatatctttgcttacctttctctgcccctgcccctcaccacatctcaatgtatctgtggtgattttccttttgcttaagttgcattctttaagtggttatatgttagaaataaattctcaggttgtatagtttggctgaaactatctttattttgctctccttctggaaaggcagttttgctgagtatagactcctagcctgagagttattttctcatatcacattgaagatatgactccataacttctggcttccattggggaagttgaggacttggccatccttactaggtgacttgtctttattctttgtctcttttaagctttcttggtcttctatagttttgttaagattgtttgggaattcatttgttgggtttattggatccgaggatcctcagatccaataaacccaacaaatcatcaggaaacagttgtcagaagacatcattggtcctgtgtttcctacggaaataaaaaacaataaatattgcactgaatgtttgtggtttggtgtccctgaataataaagaaggaacatatttgcaaaaagttgcatagggtttttttatgcagaattttgtcagaagacagtggtgctgccatgtttttctttgagtgcaaatgtacattgctaagatttttttaagatggcatgtgctttgaaaagaggatattgcatttttaagagtttaaaaatcttatgagtgagaaatattaaaaaatcttattttcccctctttacaagaaataaaagatgttcctcataaaaaaaaaaaaaaaaaaaaaggaaatattagccgaataggttatacagagttaccatatgacccagcaattccactctgaggtatattccccaaagacttgaagacagggactcaaacagatacttatacaccagtgttcatagcggcagtattcagtatagccaaaaggtggaaccaacctgagtggccatgaacagatgaatggatgaacgcaatgcgctgtatccacccaatggaatgttattcagacttaaagagagatgaagtactcatctatgcagccgtgtggatggactatgaacagtttatgctaattgaaagaggccagacacaaaaatgcacgtattttatgattccatttatacaaaaagttcagaatagagacagaaaatagattcatgcttggcagggcctggggggaggggagaatagggagtgcctgcttaaggggtgtggggtttccttttgatatcatgaaatgttctggaactagacagagataatagttgtgcaatgttgtgaatgtacttgatgccattgaattaatacactttaaaatggctccaaggataaattctgtgttatgtatattttaccacaattgaaaagaaacactggctgggcacagtggctcatgtccgtaatcccagcactttgggaagctgaggtgggcggatcacctgaggtcaggagttcgagaccagcctggccaacatggagaaaccctgtctctactaaaaatacaaaattagccaggagtggtggtgcatgcctatcaccccagctactcaggaggccgaggcaggagaatcacttgaacccaggaggcagaggttgcagtgagccgagattgtgccattgcactccagcctggtcaacaagagtgaaactgtctcaaaaaaaaaaaaaaaaaagaaaagaaaagaaacactggttgtgttgtgaaaatcctcagaaatagggaggggagcctggagcacctaactgcccttcccactgccttctcagccccagagagtgtcccctctgtccttcatcagagcacgcgaggagctccattcctggtcgtcatctgaggatgacacaatgagtaggactaggactttaaaactagtgtgtggaggttatatcctccatgtactgcgtcttaagttgggccatgtgtgtattggtccccaaagcattttttcagctaaattgcataatgactgttattttaaaaactggaaaaggaaaatcttaatgttacattatacctgtggcattgtcttgaaataagtttcaccatttaaatccactcttcacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctca

SEQ ID NO: 942 - DNA, 1707 bp, mus musculus
caccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtaaggtggcccggggcaaggcagggaccgggactggtcttccgggagcctggaat

SEQ ID NO: 943 - DNA, 1707 bp, mus musculus; identical to SEQ ID NO: 942

SEQ ID NO: 944 - DNA, 24571 bp, mus musculus
caccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtaaggtggcccggggcaaggcagggaccgggactggtcttccgggagcctggaatggcctggggagggggaagtgtaggggggagggtaccatgctggatcccattctatcagatcaggtccaagaggatgggaaagtcctgctcgtagaatttggtagattcatcggaatctccagcttagcctcgcgcctccttagagggagatcctgagatgagagaggatatttaggcgtgactgaggtggaagccaggtctctgcattcccattcccctgtatgaagtaggaggtttcagagggctgaggagagtagagaaggtttgaaacagtcataatgagccgtgagactgggaattgacatgtggagtataggatttcggaaaccatttgaggttgatgattatggagttatcttgatgccagtttgtcctgtgaggagactttgcaatggtgtttacaggcacagagaaagccaaaagcagagagtttggtggaaaggcattgattctaaccctacctatccctaatctttctgtttcatgtttcttctctgtctgttttatgcgcaggctccagggcttttctcctgaatttccaaacatgcaggcacagtccagcggctcttgcaacacttcttgcacattgtgtgtctcaggcgcttgtgtagtgaatagacttgctttcccctggctcatgtgcgcctctctgtctcccctccccctccttccctctctcatttcccctctccctctcttcctcttcctcccccttcccctcctcctctcccttcccccttctccctgtagctggcgtttgcaggatatttgaccatatcccattcacatcaggtcacaaaagctgcctggtcagcttcctctagtgtcgacaagacctcagggttgggtgtcccccactccaccccatccgtttgacagatggagccttcaattggcagtagcagtttgtgactgcaggaggagctttgtgaaaagacactgccccctcttttttgtttttccatttttgttttttgtttttttctgtatatctgaagatgctaaagtggggcttaaacagtctcaaaatgtgttctgtgtgggtcagtgtatggcctgagggaagggtttgttctgcacagtgctgaccataggagtctacttagtgacatgggagtgtgtttccccaaactttatgtgagttggaagggtgccgccttctgcactgtgcagtcagtccagaggaggaggaaaagtagtgctgggtgggcggaagtgagttaagtttccattcattattttatagtgtaattcagcattcccctgagatgaagctctgaggacaaacgttgaagatattaatgaagagggattttgttgttgttacagaaccagggtttcagagtgatttcagaagctggctaactaatttttctcccagtaatcaaatggttttcttagtcagtttctgaaattgctaggaagtctgtgttctttcctgatttccagagtgatggaaggtaaggcacagggtgacttgtcacatcttaacaaaaacatcctttcatctgctgatcctgtatttacagatataacagtaattgtccctaacccttcttcacaggcctgagggaactcctcccctgggcggaatgctgtgcattttatggctttaagacatgacaatctcccagaaacttttgcttttttttttttttttttttcatttttactaacatctatttgagtactggctggggtgaagcattaaagagaatagagaggagggtagaggacagtctttgccctctaggaggttagagtctgtgtgggtgacagtgactgtgagggaagacactggtgttgctgtttggaaggccgatggggcttcctttgcagggctgcagggacatctgggagcaagctttaggctcttccagactttagtgactgagtccttcctcccgcattgggcacttaccaccaatcagtgggttgattacagtgcttgtattcttggttcctaggaagataacgttactgccgactcactgatgggttttccaaaagtttgtcacactctattctagagaagggaggagaagagagggggagggatccttactgaagggctatgtgtcatgcactgagttaggcattgtacatatatcattatttataccagttttccagatgaggaatccgagactcagagaagtaatttgcccaaagtcatacctgggctggtgagggtggaacagtgtttggtgttagactccagagctcataatcctctcttttatacctcacctggcccctgccttggcattccctggcagcaccctgatactccagctaggctagtatgaggtggaaaacacactcagctttattactaatatgtcccaaccactgaacaaataaaatatccctgagctgccgacagtgcctacacaggaaagccgacaactttacagccatcctccccacagggcatctcagggtgccctcagctcaactgaggagagaggccacatgtgaattaacctgagtaacttctggatggtccatacccaatggccaggatttggcagtgagggagtcagtgaagttttttctggtctgggtaggggccgtagcaccctgaaccaagtcaccaaggacctaggccctttctatcttttacatcttggctttcattcactggcttatcttcccactgtaacaagatggtagccacagctccaagcaaaacatcttcacacaacgacacagggttattaaaatacagaaaggaaggaagctatctagccagtaaggggtggaggggtttttcctcctgccatgctcttttttttttttttttttttttttgagtggcagctcttactctgtcacccaggctggagtacagtggtgtaatcttggctcactgcaatttcctcctcccaggctcaagtgatcctcccacctcagcctcccaagcatctgggcccacaggtgcgtaccaccacatccaatctttcacccaggctggagtgcaatgtcatggctcactgcagcctcaacttcccagggttaagcaatcctcccacctcagcctcccaagtagctgggactacaggtgcacaccaccactcaatctcattaaaagaaattttttttttgcaaagattggggatgggcggggagtgggggctctcactgtgttgcccaggttagtctcgtactcctgagctcaagctatctgcctgcctcggcctctcaaagtgctgggattatggatgtgaatcactgcacccagccttaataaattataacacctttcccagaaccccctttaccagccgacgtccctttatgtctcattagctaaaactgggttatacagcctgccctagcccaatcattggtgaaagggaatgggagcattgtgattggcttagaccagcggttctcagccctggctgaacattacatttacatgaggagcttttttatttatttttttaatgccaatgcctgagctccacccccagagattctgatttaagtagtctggagtggagtccccagactcaggcactgggatgtttgaaaagctccccagatgatcctactgtatagccaaagctgagaacctctggctcagaccagtcatggttcatcccctgggccagatgggaccagaaggctgccaccggaacaagatcaggatggggaataaagggctgttgatgagcactgaactgcttgccacagtaatttatgtgaaagaacttggagctatgaagtgccaagcagatgtagagtgttattatggaaaggggaaaatgtcctcaattatacatgggtccatttatcaccctctcacatgccttcacatgctttgttgtctgtagctcattatctaattatctaataatccatcattgtacactatccaccactgttctggacagactgatgtgctatcctgtccttttcagcatgtctccctttaatgtctgcccttggtaggtcccaaagtttcatcccgctaggcatttaaggcaccttgatctttgctcttgacatgacatatgcatcctttgaaagaaattaggaaagaaggcaaacaccctgtaatttgaaccctaacaatcaggaagctttctttctaaagaaatcatgtaaacaggaaaagaaatgatcaaccaccaccaaatcattttgaaaatctattttaatcaggaaactgggccacaaacattttatataggcttatgtataaatatcactgaggccgggtgcagtagctcacacctataatcccagcactttgggaggctgaggcaggaagatcgcttgaggtcaggagttcaagaccagcttaggcaacatagtgagacaacccccaccatctttacaatttttttttaaactagctgagggtagtggcgcgcatctgtagtcccagctacttgagagggtgaggtaggaggatcgcttgagcccaagaagtcgaggctgcaatgagctgtgatcacgccactgcgctctagtctggatgatagagagagaccctgtctcaaaagataaataaatatcactgaaaagtgaagctgttgcttacacacagactgctaaagaatgggcattttttttttttttttttgagatggagtcttgctctgttgccaagctggagtgcagtggtgcgatctcggctcactgcaacctctgcctcccaggttcaagcaattctcctgcctcagcctccccagtagctgggactacaggtgtgtgccaccatgcccagctaatttttttgtatttttagtaaagacggggtttcaccatgttggccaggatggtcttgatctcttgacctcgtgatccacccgcctcggcctcccaaagcgctgggattacaggcgtgagctaccgtgcccagcccagaatggacatttttgaaacattgctcctatatagaatttctcattcaacaaaattatcttcagactcctaatagcatatcaacctgggtgctaggtttgagccagagagctggaagttaggatggtgtgtgtgtgcgcatgtgtgtgtgcacatggataggtacctgagtagcagggctgcaatgaggtgtgaacaatttttaaaaatacatccatgtccaaatcattattgctccttgtgaggttaatgctacctttgatcaaggcactcggagctcccatttgggcctgccttccctggcaggacccctcagctgatggatacggtgttaaggaaaagtcaagacttgtcaagtctgatgagtgaacagggaaggaggctggtcctacaaagcaaggggtggacataaagtagtaacagtcattccttgctttctatatgaagtcagtttttgaattacggcatgggaacccaggcatcagggcctgcctctcctggttactacttaattgacctttggcaagtccctaaaccttttcagctttagtgttcttaccaataagaagaggaagtcaaattaaaaggatttctgggccaggcgtagtggcccatgcctgtaatctcagcactttgggaagctgaggcgggcggatcacttgaggtcaggagttcgagatcagcctgaccaacatagtgaaaccccatctctactaaaaatacaaaaattagctgggcatggtggcgggcacctgtagtcccagctacgcgggaggctgaggcagaagaatcacttgaaccctggaggcaaaggttgaagtgagctgagattgcaccattgcactccagcctgggtgatagagccagactctgtctccaaaaaaaaaaaaaaaataataataataataattaaataagggccaggtgcagtggctcatgcctgtaatcccagcactttggtaggccgaggcaggtggaccacaaggtcaggagttcgagaccagcctgaccaacatggtgaaaccctgtctctactaaaaatacaaaaattagccgggcatggtggcgcgtgcctgtaatctcagctactcaggaggctgaggcacgagaattgcttgaaccagggaggcagaggttgcagtgagctgagatcgcgccactgcactctagcctgggcgacagagcgagactctgtctcagaaaaaaaaattgtagaaataacataagcatgtggtaaaaatagaaatttttttttgaggcggagtttcgctcttgttgcccaggctggagtgcaatggcacgatctcggctcacctcaacctacaccatctgggttcaagcaattctcctgcctcagcctcctgagtagctgggattacaggcatgcgccaccacacccagctaattttgtatttttagtagagacagggtttctccatgttggtcaggctggtctcgaactcctgacctcaggtgatctgcccgcctcagcctcccaaagtgctaggattacaggcgtgagtcactgcgcccggtcaaaaatagaatttaacaggatagaagtttataaaatacctgccagtctcacttcctagaagcagccacaatatttcttgtagtatatgtctagaaatgttttacgcaaattccggcagaaaaatatagcctttttatacacaaatgggattgaactctatttattgttctgcacttttttcacttattgctttgaaaatcttcccgtttcatcttctttttaatagctatattgtatttcatggtaggaatgtattataacatatttaactagctcctagttccatactgtagggcatttagttgttatagttttgtgctctatttcattgcatttctagtagggtccttgtatttgcatacatgtgagtatgtctgtcagaaaaattcctatagcagagtgaccttatatagcaaaaggtatatgctttgtacattttgagaggtaatgttcttcaaagtcgtccaacattcactaccaccagcaatttcttggaacgtctgtttcccagactttcaacaacatagatttgatttcattttttcatcttggccagtttgatgaatggaaaattcttgctgctggcatcctggctctctctgaccctacagttcatctctgatgatgaatgatggcctcatactttgggttgtagtcactggaatgccaaaatgaaatcaacttcttagcccttctacagtccacatgtatttagagagtgttatttttgtgattattttgaagaaatggatacattttggtataaaaattatccctttagaaaatcacacttcgacaggacatcaggttttagcaaggttcttgttcaggcggccttcttctggtactgttgcaggggattgtacttactgactcgagcataaacaatttggggaccctatcactggggaaattaggctgattttaaataaggtttaaccattcatacattttctctatgttcctgagagccctctttgtggtctcagcaggggaagggcagaagtgcccatttgcagtttttgaggcaggattcagacggttttctaagaggtttttttttttttttgtcttggcagagattttcttcccatgaatatgaatgtaatataaatagttgggagtgaagcttttgaaaaacatttacaaacagctggtttaacattcttcagtatgctttgtctcagcctgccctcagcatgagcaggccagaaaagaatgaaacaaaaaaaactaaactggcctcacttttttgtgtctgacgttccagttgaacaaggtgactaataaatgaacccctctctttgtgaggtctcctggctcctcagcctcttgcttcatagtggaaataaaaggaacttgctctattgaaaaggacatttctgctgaggtgcagtataaaataagaatagtagggattaagaaacagctctggctcaaattcaagtccacaggcaagtgggaactgtttgggaattgaataggaagcagttttaattggagaaaatagaaaattgcggagctcagtgatgtgtctataattggagtccttcagctttgctccccggcccgcttggcaccctggcaccaagccagtggccaggtctgacattttctgcagctgaccctgttcataattaagaccaccctgctggatgctgagaataaattagagcatcagctgatgatgaatatttttaaaaatttgttatgaatacatatttgtacatgtttatggagtgcatgtgattttttcgttacatgcacagtgtgtaatgatcaagtcggtattggggtgcccatcacctcgagtgtttataattttgatgtgttgggaagatttcaagtcctctctcctggctattttgaaatacaccatacattgttgttaactgtagtcaccgtactctgctattgaacttagaacttacttcttctatctaactgtgtgttcatacccatttaaccaatctgtctccacgacaacccccacaccctttgcagcttctggtgaccaccattctattctctacctccatgggatcaacttttttagctcacatctgagtgagaacatgcaatatttgtctttctgtgcctggcttatttcacttaacgtaatgacttccagttcttctgatggtgaatatttttaaattcggagattaagaggctgtgaaagagggccaccacatttgatttcaatgatgactatattctgtgccagcagattcccctcccatgaaatggatgggagcaggaagaactttgctgtagagtcacattctgaaaatagccactgaggtagacacgttttgcttacagaatcgaagccctttctagaatgttaaaaggtgccttggccgggtgcggtggctcacacctgtaatcccagcactttgggaagccaaggcaggcagatcacccgaggttgggagttcaagaccagcctgaccaacatggagaaaccccgcctctactaaaaatataaaattagccaggcgtggtggcacatgcctataatcccagctactcgggaggctgaggcaggagaatcacttaaacccgggaggcggagattgtggtgagccgagatcgcaccattgcactccagtctgggcaacaacagtgaaactgtctcaaaaaaaaaaaaaaaaaaaggtgccctgaagatagatgcagggtactctctgggccagtaggccagtaagaagcctgaagtctggcctgaaatccaaatgcctagagcgagtgcttgtttgattttaatatcactggttcatggtatccagcaggttggaaaccaggaagccaacctaactgaagggctgaagtgtgtaattctgccctgaaatagaacatcacagaaagctttgtaaggcatggggagtgcagccgtgatcaagactgtgagttcttcagtaaagatgatgaagtgaggaaagctatgagcagctttaggagggaactcagaggctaattgaagaagtcattacatccagacagataaggtagacattaggaaaaattgtaccagagctttgaggtcacttttcccatgattgagaccatattttctcaaaaaggactctttactgcctcagagaaattataggaacagtaagccaaaaatgctaaaatcaacataatattttaaaaataggaccaactggcgaccagccaagaactggcatatgttaaatacacagattttagaagtaagagaagtagatctgtctcttgctataataaagaatatcactaacatggatataataaaggaaaaaaacacatttttcagggtctgcacataacaaaaaagttcctctttgttgtttttctgcaccctcccactttctcttttttttcttttcctttctttctttttttcttttcttttcttttttttttttttgagacagtcttattctgttgcccaggctggagtgcagtggcatgatctgggctcactgcaacctccgcctcccgggtttaagcaattcttgtccctcagcctccagagtagctgggactacaggcatgcgccaccacgcccggctaatatttatatttttaatagagatgtggtttcaccacattggccaggctggtctcgaattactgacctcaggtgatccacccaccttggcttcccaaagtgctgggattacaggggtgacccaccacacctggcccaccctcccattttctagctgctaggaattacagagggcaattttgcaaaaaggagatgattggccaaaaacgtacacatccctcgcaaagaataacaaaattcctaacattattgaatgccttttaaaataattttacttcatatttatttatgtatgtatttatctatttttgagacggagtcttgctctgttgcccaggctggagtgcagtgacgcgatatcggctcaatgcaacctgtgcctcctgagttcgagcgattctcgtgcttcggcctccagagtatctgggactacaggcacctgccaccacgcctggctaatttttttgtattttcagtagagacagggtttccccatgttggccaggctggtctcaacctcctgacaagtgatccgcctgcctcggcctcccaaagtgctgggattagaggggtgagtcaccacacccagccatttttatttttcaacagtcaaaggggaagagaaatcatctgagctcaggaaaaacccatgtcttgatccttagtgcggccacctccagcaatcctgtagactggcctccacgatccaatgtcctatgccaacacgaacctgctctaggccacggagccactttactcccacaagaccatggacaagaaaggctaggaaagggtggaacaaacatactgcctcactctgcagggagagatacctgcagtgattggctagagtttggctggtccatagattctgtacactgactagccattctaacctgggaatcttaaagctgatcaagggcagagaatgagacttcctgggcagtcccagtgtgggggtagggaaacttcagttgctcatttgactgataacccctatggggaccaatggcagcctgaattgcagatctaagctccaggtcacttcccagctctgtgctctcccaaatcccttccactctcacttagtggatcacaaacatctgcaggtggcttgtccaaatatatattataaaatactgagtcagttcctttattggagttgggagcaactttactcacaaaagcaattaggtatgcaaactaaatttatatcttggagcagctcaatgaaaggaaaaaacaaaagtcaactaggcaaactcagctgtttccaagtttttttttttgtttttttttgagatggagtttcactcttgttgcccaggctggagtgcaatagcacgatctcggttcaccacaacctccgcctcccaggttcaagcaattctcctgcctcagcctcctgagtagctgggattataggcatgcaccaccacacccagctaattttgtgtttttaatagagatggggtttctccatgttggtcaggctggtctcaaactcccgacctcagctgatccacccgcctcggcctcccaaaatgctgggattacaggcgtgagccaccacgcctggctccaggttttattaatactggtttggtgtgcatccatttgttctcaagtgagctcaaaagtttgggaaatttttagctggggtgggtatcataaaactggagagatgttattatcttattctattctagaataagaggaaaaataatgcccatttaatttttgtactggctgactctgggcttgaatgactcacgtggattgagattttacattgaattcctcccacggtgggaggtgacggcgggagtgtgtgtctctttagctctccactggggccatccaagtccaggcaagtttctcccctcactccccagtccagagttttgtctttttgtttttgttttgttttgactcagcctctatttctttttaaacctgagtggagagttgtttcaagttgaatatgactgaaactgttattgactagtgcaagtataaataactagcaccccgtgccactgccacataatttttcagattaaatgtctggaaattatgaataacatttaatgctgtttaaagtacgtttccaggctatctgggggtgcagttatattagcaaactaaatgtttcctattacattttgctttggagtcacaatgagggaatgtactttgagatttctgctatttcaaatattattttaacattatccctaagcagctcccttaaaaaacaacttaatggtgctattgttgtaaacattgtcactcatttccgttttccttggcactgtagttgctaatttgaagtgaaaacaggaaggttaagaaagcttaacctgggttaacagataagcttagatattaacatcatccacaaagtgtggtttcagtttaggatgctgggagaagaccccataaggacacagccgttgcaaaggacgctcaagcccttcctcagcccatttgttctggaggtggtccaggaggaaggctgttacaataggctggaaagtcatccagctggtggtaacaggacttgctgaatactcggaaatctcagctctctcaagtgctaagcgccagcaccaacttttagcatctgtgaagtagttttggtggtcaatccagggtgcctcacctggtgcaagtgtgtgggcagggacaggataactgagtccagtcacaggcatgtatgttttggaggcaagaccaagaaaaacttgaagaggagcaggcccaaattgacaaacataattcaaggagtagaaatgaggtccccgtgcaagttcccagattcatttgggaggccctaggctcattacctgacttgaaatggggggcacaggaaggccactgagagaggcagagcctgttgcaagttcattggcttgaatcttctgttctctaactttaaagccagcaggaagttgattcatccccctcccccatcccggcttcaaagattgaagaaagtatgattaaaatgctaaaagcgcgtcttcctgagttattctgctgtagccccaggagcctcagccgagccaagtgcttgcaattcaggctccatagacccagaatgaacccagaatgaagtttccctttgatggcaatgaggctattagtaggtcaaccagctgcatttagggcctggctggtcatttaaacactcaagggaactgtagcaaaggagataaaattacacccagctcattgaaatatgactttcaatctttaaataaataaccatgctttttttttaaagtgaaagccaattcttgaattatttgaatattgaggaatgacctcacatttcaatgtcactttttttttttacaaaaaaccttttatgcgtgcttttcaaaacaacggtatataaaaacctttataattcttgagattaattgcatgaagacagttttttattatgaattttctattattacaggataggtctttaaatagttctgacttaggaataaacagaagggtctatgattgtttcaggtgagacagagagtagcaaacattttcattctccccagattctgggcaagtggaaacagttgtaaccaagaagtttagcagcttaaaattttaatttttccttgtcagacatctagcagctgaaaaaaaggacaaaactagctacttggtaactgcagctggctggtaaactgagggtttgagttctaaatatgcacccaaagatgaatatttcattgctccctatgaacagggccccataatattaagaagagttgggatccggattaagagtgaattgaattcttaatccttgtgctcacacctgtaattcccagcactttgggaggccagggtgggcagatcacctgaggtcaagagtttgagaccagcctggccaacatagtgaaaccccgtctctgctaaaaatacaaaaattagccaggtgtggtggcaggcacctgtaatcccaactactcgggaggctgaggccagagaattgcttgaacccaggaggtagaggctgcagtgagccaagatcgcacccctgcactccagcctgggcgacagagagagactctgtctcaaaaaaaaaaaaaagagtgaattaaattcttaatcctctatttaagattctggggacttaagagtttgaggaaacatcacagtaagaattcatagacacatttatgttttaaacacaaccaaaaatattgagaaatggtaggaaattagctgatagtttacttagggtgtacttgggagctacaggtctcatgaaggtgtaagtcagaaccggaagatatataagcatccttgacatagttcagggacattcaggaactagaggccaacacgggggaataggaacccattgcagaaagaaagggccttgtgaggttgccctgcctgaattagcggtacttcatttaagttcttcaaataccccagcagcagccagcaatagttctttcagagcacacatctctccttccctcaccttgtactgccagcgattcaataaaaaatatgaacctgcatgaaaagcagccttttgggtagatacaaagattttttaataaaaggatataaaagagtgcttatgggtacagatgttgggctggtagtactctccataaaagtttgttgagaaatgggatctgacctggcaacatttagcacttggttagtcattgacaaaaccatcctgagttaatgccaagtttgtttccggtctttaaagccacccaagtgaagagctcaacatgttgcacaaagaaacaatgacagattttttttttttttactttttattttgaaataattatataggccgagtgtggtggctgatgcctttaatcccagcacttagggaagtcaaggcgggaggattacttgagcccaggaattcaagaccagcctaggcaacataagggcatcccgtctctacaaaaaaataaaaaattagctgggtgtgcctgtagtcttagctactcaggaggctgaggtgggaggattacttgagcccaggaatttgaggttgcagtgagctatgatcacgccactgcagaaataatatactcacaggaagttgcaaaaacagtacaagaggtccagtgtacccttcaaatagcttcccccaaaggaacaccttatatgtagatcaatatcaacaccaggaaattgacactggtgagatctaacaacagaccttattccattttcagcagtttttacgtgtactcattttgtgtgtgtgtatagatctgtgtaattttattacatatagatttgtgtaaacaccactacaatcaagacacaaagctagtccatcaacacaaaaaaactctcttgtgctaccctcattatcattacataccctaccctatcccacccctttcactggcaaacactaatctgttctccatctctataattgtgttatttcaataatgttatataatggaattacataatatgtaaccttttgagattggcatttttcactcagttgtaatcctctggagattcatccaggttgtcttgtttaataatagtttgttctttttcattgctgagtaatatttcatggtatggttgtaccagtttgtttaaccattcactcactgaaggacatttggattgttttcagtttttggctattacaaataaagctactatgaatatttgtgtatgggtttttgtgtggacataagttttcatttctttaggatgaatgtccagaaatgcaattgctggatcgtgtggaagtgtctgtttagttttataagaaactaccaaactgttgctgagagcagctgtacccttctacattcccaccaacaatgtctgaaagatcaaatttttctacatcttcacagtatttggtattgtcactatatttcattttatttttattttatttttttcagatggagtctcactctgtcgcgcaggttggagtgcagtggtgcgatctcggctcgctgcaaccgctgcctcctgggttcaagcgattctcctgcctcagcctccccagtagctgggattacaggggtgcgccatcacacccagctagtttttgtatttttagtagaaacagggtttcaccatgttggccaggctggtctggaactcctaacctcaagtgatctgcccgcctcagcctcccaaagtgctgagattacaggcgtgagccaccgcgcctggccgagatttctttttttaaaaaaaatctcttttttattttattttactttaagttctgggatatatgtgctgaacatgcaggtttgttacataggtatacatgtgccatggtggtttgctgcacctatcaagccatcatctaggttttaagccccgcgtgcattagatatttgtcctaatgctctccctcccattgccccacaccccctgacaggccccagtatgtgacgttcccctccctatgtccatctgttctcattgttcagctcccacttatgagtgagaacatttgctgtttggttttctgttcctgtgttagtttgctgaggatgatggtttccagcttcatccatgtcccagcaaaggacgtgaatgagatttctttttcaagagccttttaactattaattcaattttttagtagttacaggacttttcaaattatctatttcatattgggtgagttatagtagtttgtgctttttgaggaattggtccatttcatctaaattgtcaaattaatggatgtagagttgtttttagtaatttttttttcttttgccttttaatgtctgtggtgtctgtaatgaaaacccctgtttcattgctgatactggtaatgtttgtcttctctttttctgttgtcagtcttgatagaagttttttgtttgttttctgtttttgtttgtttttgttttttgttttgttttgttttgagacagggtctcactcccattgcccaggctggagtacagtgatgcaatctcagctcacccgccttctgggttcgagcaattctcctgcctcagcctcctgagtagctgggactacaagtgctcgtcaccacacccggctaatttttgtattttttgtagagacagggttttgccatgttggccaggctggtctcgaactcctggcctcaagtgatccacccgccttggccttccaaagtgctgggattacaggcatgagccactgtacctggctgatagaggttttttgatcttttcaaagtaccagctttttgtttcattgtattttgattgtttttgttttcagttttactgatttctccttttatcttaattatttccttacttctgcttgttttgggtttttttaatcatctagtttcttgaggtaagtacatagattattgatttgagatctttttttctcatgtatgtatctagtgttacacattttcctcttagcttcacaaattttgatgttgcattttcattcaatatagttttattttcaatgaattatatttaagtatgttctttaattttaaaatttctggataatttcctgctatctttctgttattgacttctagtttgattacactatggttatttaatttattattattatttcaatttttaaacatttgttcagatttgttttgtggaccaggataggttcatgttgtgaatgttccatgtatacctaaaaataatgtgtattctgttaataggtggaatgttctataaatgtcagttcaattctgttggttgatggtactgttcagtccttctgtatccttactgactctctgtctagtgagtccatcatttgttgaaagaatggtgttgaagttttcaactatagactcgtccatttcttctttctgttctttcagtttttgcctcaggaaatttgaagctctgctatttgctctgtacatatttaggattgctataacttgtttttggattgaccttttaaaccttatgtaacattcttctttgtccctggtaattttctttgctctgaagtctattttatctaatattaatatagctactcttcctttcttttgattaatgtttgtatggtgtatccttttcagccttttactttcagcccatctcattatattagaaattaatggtaatgtttttaaatccattttgccaatctcttttagtttatgtatttaaaccatttatacttaatctaattattgatattttaggacttcaatttgatttgtttgttccctctgtttttattcctttgttttccttttcctgtcttcctttgagttacttcaacattttttagaatttcattttatctgtagtgtttttgagggtatctctttgtatgtttattttagtggtttccttgaattatacatgtgtaacttatcacagcctactggtgtcaacatcttactacctccaatgaaatgtagaaaactaatctccatttaggttcctttatcctgccccttaaatagtctcttaaaaattttctctacatatattgagaaccacatcatacaatgttactttgcctcaaccatcaaaaataattttaaaaactcaagagaatagtttattaaatttactcatattttacctttccgttgttctttcttcatttgtgatatttcaagcctccttttgtcatttcctttctctggggaagaactttagcagttcttttataaaagttctgttggcaaaaattatcttagttttctttcatgtgaaaatgtctttatttcaccttcattcctgaaggatattatcatgggatatagaaatctggatcgaggctgggcactgtggctcactcctgtgatcccagcactttgggaggccaaggcaggtggatcacttgaggtcaggagttcaagaccagcctggccaacgtggcgaaaccccatctctactaaaaatacaaaaattagctgggtgtggtgacgggcacctgtaatccagctacttggaagaccaaggaatgagaatcatctgaacccaggaggcggaggttgcagtgagccaagatcacgccactgcactccagcctgggtgacagtgagactctgtccaaaaaaaaaaaaaaagaaaaatctggattggcagatattttctttcagcacttgaaaactgtcgtgtcacctccttctgacccccatgctttcagatacaaaatccgttggcattcatattgttgttcccataattaatgtgtcatttctctctagttgccttcaggatttttttgtctttactttgctgaagtttgactatgccatggcttggtgtagatttctttgagcttttcttctttggggtttgctcaagttcttgaatctgtaaatttatgtcttctgccaaatttgggaaactttcagccatatttcaagtactttttcagtctctttttctggaactttgatgacatgcatgatagatcatttattatggttccacaggcccctgaggctctgtttatctttttttaactctattttctgttgttcagatttgataatttctattgttctatttttagattcactaagtccttactctatcatctctattctgctattgagcccatccagtgagtttttcaaatttttgttattgtattttacagttctaaaatttctatttggttgctttttaaaaaattattcgctgagaatttcaatttttttatttgcttcaagtgtgtttgtaatggctaattgaggatgtttatgattgccacttaaaatctgtttcagataatttcaacatctgtgtcatctcagtgttggtatgtatcagttgtcttttctcattcaagctgaaatttccctggttcttggtttgacaagtgctctttttattgtcctggacactggaagaattatcttatgaatctccaaatcttatttaaatcttcttttttagcaggcctccactgacaccacactggtggagaaaggggcacatcacctggttactgccaggtcaaggtggcagtccagagatcctggcttcccactagggctttgctcacaggagaggggatttttttttttaattgtggtgcttggtttctgtcttttttagagtgaacctttcctgtcctttggctagaggtaacaggcttttttcagggcttttttgtgtgtgtctgtcacagttggcatttctggcttgctggcttctttagcacacaacattcaggatatagaggcagcaaaaagaaaactcagggtcatagtattcctcagttgccaaggttcctagtcagttggccttcttctctccacccttcagactcttatctttgttttatacataatattcggagtttttagttatactttgtgggaggaataagaagtgcatctattccatcttgtcaactagaagtcagcccatctggctgggcgcggtggctcacatctgtaatcctagcactttgggaggctgaggcgggctgatcacctggggtgaggagttcgataccagcctggccaacatggtgaaaccctgtctctactaaaaatacacaaattagctgggcgtggtggtgcacgcctgtaatcccagctactcgggaggctgaggcacgagaatcgcttgaacccaggaggcagagattgcagtgagccgagatcattgcactgcactccagcctgggtgacagagctagactctgtcaaaaaaaaaaaaaaaagtcggcccacctggaaattggtttttattaaagactgaaatttgacatggtggctctttatgtaagtaacctgttgtggaggctaaagtaactccatcttggatgctaatccactatgttgacttgtgattaaccctggttccaggaatgcctctgagatttccagttcatctattgttccttgtgttaagagcacatccttaccataaatcctgcccttagatcaaactcctactcattccctctgaaacacgtgtaccttttcctgtggtttataatccctgggtctgggggtggggggtaatggtgtggagatctatctgccttgcagctgctcaagaccatacttctgtccataagttccccgataaaatcaccctgtgatgacaagctggacttatctgcctccttctttggtttctcagccccttctgcatttgggggtcactttgcttatatagccctttcatgaaacatgtgtactagcaaaatactaaagatttatagaaaggggttgggcacagtggctcatgccagtaatcctagcactttgggaggccaagatgggtggatcacttgaggtcaggagttcgagaccagcctggccaacacggtgaaaccccgtctctactaaaaatacaaaaaattagccaggtgtggtgctgcacacctgtagtcacagctactcaggaggctgaggcaggagaattgctggaactcaggaggtggaggctgcagtgagcttagatcatgccactgtactccagcctgggcaacagagtgagactctgtctcaaaaaaaaaaaaaaaaattatagaaaggcctcaaagcatttctgaaattagcttttccttaatgcttagtgtgaatctttattgcacattttaaatcatcttgaaactgcctttcccaaactttgcatcagtggttctattaagctgatggacagtttcactccattagaaaatgtcaaatttggtacacatccaggatcagaggaaggatcacaggagagcaagaaactggtgacaggactagttcagacacactagagtcagcccactttccactgctcacatagagtgacacaagcaatgtgtttaaatgaaagaagaaaaaagttcaggtgccacaaagatagaaagctggactcactgcctatctacagcctcagttttatagaatcgtcagttgctgttggcgttttgcacatatgaactggtacataagtgaagaatggatgggtacgtggttggtgcctaaaggtacggtttcaatcccagttcctcctacacactacccagaaggtcccagaaagccctgttctcctcagcaggcgctccacaacagcagctgcagaaagcgcagccatgctaacagaggcgcccccggagttttcccatcttcaccctcacccaacacctcttgggtcattttctcctggtctgtcttcacaagccagaaatggttgatactgattcggtatgggtttggaagattataggtttctgatttaaaaggccttatgtcatcagggtccaacagactttctttctggggatttctgtgttctgaagttcagacgtcctttgttccttcccttctaggtcagtcaccacgaacaggggcactcggcatgctgccccagcactggagaagcagcgctgtgggggcaatctgtcacactctcagagtctgggacttgacttgctaccaacaactgctgtgcaattctgctgagcaggaatatcatgagctgttcaataatgacggacgcattggttgagatgaagtttccagtaaggaagtgacagtgcaatgtggatatttatggctgtaaaataggaagagctttagttcccaggctgaacctgccactgctggagccatttcaacaaggcatcctcacaacaaagaagagatgtgatttggtaccatttcacaccagcaggtgtctggacgaaaacatcaatgtgaataagggccaagtgcagtcctgtcttgattaaattacttaataatattattaaataataataggtctgggcagtattgtttttaacctgactcatccagctgtccttcaaatagctccgtctccctctacccagaactgatttttaaaaagaagtaatttttctccctgggctgggaaaaccctaatgaactgaaacacacttttactttaaaa

SEQ ID NO: 945 - DNA, 24571 bp, mus musculus; identical to SEQ ID NO: 944

SEQ ID NO: 946 - DNA, 244 bp, mus musculus
gattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcgga

SEQ ID NO: 947 - DNA, 37099 bp, mus musculus; identical to SEQ ID NO: 137

SEQ ID NO: 948 - DNA, 37099 bp, mus musculus; identical to SEQ ID NO: 137

SEQ ID NO: 949 - DNA, 11576 bp, mus musculus; identical to SEQ ID NO: 139

SEQ ID NO: 950 - DNA, 190502 bp, mus musculus
agacacaccctcctgcttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctcagcctcccgagtagctgggactacaggcgcccgccgccacgcccggctaattttttgtatttttagtagagacggggtttcaccgtgttagccaggatggtctcgatctcctgacctcgtgatccgcccgcctcggtctctcaaagtgctgggattacaggcgtgagccaccgcgcccggccttcattgctttattacatgccaaatgcttgtttattgtacaacagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggttttgccatgttggccaggctggtctcgaactcctgacctcaaatgatccgcctgcctcggcctcccaaagtgctgggattacaggcgtgagacaccatgcccagccttgagtgagttattatattcttaatgtataatattgaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggggtttcaccatgttagccaggatggtttcgatctcctgacctcgtaatctgcccgcctcggcctcccaaagtgctgggattacaggcgtgagccactgcacccggcctcctcctctcctctcctcccctcccctcccctcccctcctttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaattttattgttagagtgggggattatgagtcagaaattttaaggtcagctgggcacggtggctcacgcctgtaatcccagcacttttggaggccaagatgggcagatcacttgaggtcaggagtttgagaccagcctggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccaggaggcggaggttgcagtgagccaaaatagcgccactgcactccagtctgggtgacagagcgagactctgtctcaaaaaaaaaaaaaagtattaccatataacccagcaattctattaggtggaattgggaaattctccccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcaccatgctcaccaggcaggtctcaaactcctgaccttgtgatccgcctgccttggcctcccaaagtgctgggattacaggcgtgagccaccacgcccgaccacccatactattttctacctcccagcatttcttcgtggggtgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcaccaagaaaacccagttgaagaaggtgtgccggccgggcggggtggctcacacctgtaatcccagcactttgggaggccgaggcgggtggatcacgaggtcaggagatcgagaccatcctggctaacatggtgaaaccccgtctctactaaaaaatacaaaaaattagtcaggcgtggtggtgggcgcctgtagccccagctactcgggaggctgaggcaggagaatggcgtgaatccgggaggcggagcttgcagtgagccgagatcgcgccactgcaccccagcctgggcgacagagcgagactctgtctcaaaaaaaaaaaaaaaaaagaaggtgtgcctgtttagtcacgagtgggatacaggataaacgtaaatcacctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcaccatgttggccgggctggtctctaactcctgatctcaggtgatctgcccaccacggcctcccaaagtgctgggattacaggcgtgagacaccacgcctggccttacatagcttttagaatatattatctcatgcagttgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggagaattattaagcttttttaccttgttaaaaccacttgtgaggccgggtgcagtggctcacgcctgtaatcccagcactttgggaggccgaggcgggcagatcacaaggtcaggagatcgagaccatcctggctaacacggtgaaaccctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaaggtcatacagcaaacaaatgcaagagccagaattacactgttgcttttttttttttttttttttttttttttttttgagacagagtttcgctcttgtcacccaggctggagtgcagtggcgcgatctcggctcactgcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttgggaggctgaggtgggtggatcacgaggtcagatcgagaccatcctggctaacatggtgaaaccccgtctctactaaaaatacaaaaattagccgggcatggtggcgggcgcccgtagtcccagctactcaggaggctgaggccggagaatggcgtgaacccaggaggtggagcttgcagtgagccgagatcgcgccactgtactccagcccgggagacagaatgagactctgtctcaaaaaaaaaaaaaaaaaaaaaaaaaaagagaagaaatagaatccaagaagtaatctgaggccaaatcctgtgcagttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctctactaaaaatacaaaaattagccaggtgtggtggcacgcacctgtaatcccagctacacaggaggctgaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttcaaagctatttttcaaaatttagggacacagtcatgatcctctaatctaggattttttttttttttttttgagacagagtctcactctatcgcccaggctggagtgcagtagcacgatctcacctcactgcaacctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctcagcctcccaagtagctgggattacaggcatgcgccaccacacctggctaatttttgtatttttagtagagacggggtttcaccatgttagtcaggctggtctcggattcctgacctcaggcgatccacccgcctcggcctcccaaagtgctgggattacaggcgtgagctactgtgcccggccaagaatgctttctcttaaactttgctgtgcatcaaagaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctcctaaaaaaaaaaaaaaaaaaaaaaaaaaaaaaaaaaattggttattggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagccacatgtggctattgagacttcaactggggctggttcagctgaggaacagaatttttttttttttttttttttttgagacagagtttcgctcttgttgcccctgctggagtgcaatgtctcacttcgcctcccgggttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttggccacccaaagtgctgggattacaagcatgagccaccgtgccgggccttcatttttttttttttttttttttgagacagagtctcgctctgttgcccaggctggagtgcagtggcgtgatcttggctcactgcaagctccgcctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttctatatggcgattcaaaaatgtgagaggctggccaggcacagtagctcacacctgtaatcccagcactttgggaggccgaggtgggcggatcacatgaggtcaggagttcgagaccaacctggccaacatggtgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagtagaaatctaccacagaaattactaaacttggctgggcgcgatggctaacgtctgtaatcccagcactttgggaggccgaggcgggtggattccaaggtcaggagttagagaccagcgtggccaatatggtgaaatcccgtctctactaaaaatacaaaaaaattagccgggcatggtggcacatgcctgtaatcccaactactcaggaggctgaggcagcagaattgcttgaacccgggaggcagaggttgcagtgagccgagattgcgccactgcactccagcctgggtgacagagcgagactctgtctcaaaaaaaaaaaaattactaaacctgatcacaatcccctataagtacttataaagcaagtcccaaccatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactatattggccaggatggtcctcatttcctgacctcatgatccgcccccctcagtctcccaaagtgctgggattacaggcgtgagccaccatgcccggcctatttactgtacttttaacatatatattgaaatcttactgacattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttgacaccaaagtcatggaacaaaggaaagtaatgagagttaaaaggccgggagcggtggctcacgcctgtaatcccagcactttgagaggctgaggagggtggatcacctaaggttgggagttcgagaccagcctggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctttgcaaactttaatctgcatatgaatcacctggggaatttgttaaaacaggtttttttttttttgagacagagtctcgctctgtcgcccaggctggagtgcagtggcgtgatctcggctcactgcaacctccgcctcctgggttcaagggattctcctgcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgccaccacgcccggctaatttgtttatttttagtagagatggggtttcacggtgttagccaggatggtctcgatctcctgacctcgtgatccgcccacctcggcctcccaaagtgctgggattacaggcgtgagccaccacacccggcccatgactgttttatttcttgtgaacttgatagttcctcttattcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagtgtggaagaaccttttagagatattattgactatgctggcgggccaggcgtggtggctcacgcctgtaatcccagcactttgggaagctgaggcaggaggatcacttgagcccaggagtttgagagcagcctgggcaacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaataaataataaaagaattagtaatcatgagccgggcgcagtggttcacgcctataatcccagcactttgggaggccgaggcgggcagatcacctgaggtcaggagtttgacaccagcctgaccaacatggcgaaaccccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctgcctcagcctcccaagtaggattacaggcatgcaccactatgcccagctaatttttgtatttttagtagagacggggtttcaccatgttggccaggctggtctcaaactcctgacctcaggtgatccacccaccttaacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttcaccatgttggccaggctggtctcgaactcctgatctcaggtggtcctcttgcctcggcctcccaaagtgctgggattacagtcatgagccactgctcccggccaagaaggcagtgtttcaaaccatttcccccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtttcaccctgttagccaggatggtctcaatctcctgacctcgtgatctgcctgcctcggcctcccaaagtgctgggattacaggcgtgagccaccgcgcctggcccaatgccttttattatctactttatttgaacaaaaatggtcctacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcaccgtgttagccaagatggtctcgatctcctgaccttgtgatgcgcccgccttggcctcccaaagtgctgggattacaggcgtgagccaccgtgcccggcctggccatgtattcttaaataaagcagttaggcctttccttgttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtccaggctggtctcaaactcctgacctcaagtgatccacctgtctcagccttccaaagtgctgggattacaggcgtgagccaccgcacctggcctgttaacataatatttagaggttcatgtatcagttgtagcatatatcagaacttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgt

SEQ ID NO: 951 - DNA, 93730 bp, mus musculus
cttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctcagcctcccgagtagctgggactacaggcgcccgccgccacgcccggctaattttttgtatttttagtagagacggggtttcaccgtgttagccaggatggtctcgatctcctgacctcgtgatccgcccgcctcggtctctcaaagtgctgggattacaggcgtgagccaccgcgcccggccttcattgctttattacatgccaaatgcttgtttattgtacaacagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggttttgccatgttggccaggctggtctcgaactcctgacctcaaatgatccgcctgcctcggcctcccaaagtgctgggattacaggcgtgagacaccatgcccagccttgagtgagttattatattcttaatgtataatattgaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggggtttcaccatgttagccaggatggtttcgatctcctgacctcgtaatctgcccgcctcggcctcccaaagtgctgggattacaggcgtgagccactgcacccggcctcctcctctcctctcctcccctcccctcccctcccctcctttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaattttattgttagagtgggggattatgagtcagaaattttaaggtcagctgggcacggtggctcacgcctgtaatcccagcacttttggaggccaagatgggcagatcacttgaggtcaggagtttgagaccagcctggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccaggaggcggaggttgcagtgagccaaaatagcgccactgcactccagtctgggtgacagagcgagactctgtctcaaaaaaaaaaaaaagtattaccatataacccagcaattctattaggtggaattgggaaattctccccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcaccatgctcaccaggcaggtctcaaactcctgaccttgtgatccgcctgccttggcctcccaaagtgctgggattacaggcgtgagccaccacgcccgaccacccatactattttctacctcccagcatttcttcgtggggtgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcaccaagaaaacccagttgaagaaggtgtgccggccgggcggggtggctcacacctgtaatcccagcactttgggaggccgaggcgggtggatcacgaggtcaggagatcgagaccatcctggctaacatggtgaaaccccgtctctactaaaaaatacaaaaaattagtcaggcgtggtggtgggcgcctgtagccccagctactcgggaggctgaggcaggagaatggcgtgaatccgggaggcggagcttgcagtgagccgagatcgcgccactgcaccccagcctgggcgacagagcgagactctgtctcaaaaaaaaaaaaaaaaaagaaggtgtgcctgtttagtcacgagtgggatacaggataaacgtaaatcacctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcaccatgttggccgggctggtctctaactcctgatctcaggtgatctgcccaccacggcctcccaaagtgctgggattacaggcgtgagacaccacgcctggccttacatagcttttagaatatattatctcatgcagttgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggagaattattaagcttttttaccttgttaaaaccacttgtgaggccgggtgcagtggctcacgcctgtaatcccagcactttgggaggccgaggcgggcagatcacaaggtcaggagatcgagaccatcctggctaacacggtgaaaccctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaaggtcatacagcaaacaaatgcaagagccagaattacactgttgcttttttttttttttttttttttttttttttttgagacagagtttcgctcttgtcacccaggctggagtgcagtggcgcgatctcggctcactgcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttgggaggctgaggtgggtggatcacgaggtcagatcgagaccatcctggctaacatggtgaaaccccgtctctactaaaaatacaaaaattagccgggcatggtggcgggcgcccgtagtcccagctactcaggaggctgaggccggagaatggcgtgaacccaggaggtggagcttgcagtgagccgagatcgcgccactgtactccagcccgggagacagaatgagactctgtctcaaaaaaaaaaaaaaaaaaaaaaaaaaagagaagaaatagaatccaagaagtaatctgaggccaaatcctgtgcagttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctctactaaaaatacaaaaattagccaggtgtggtggcacgcacctgtaatcccagctacacaggaggctgaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttcaaagctatttttcaaaatttagggacacagtcatgatcctctaatctaggattttttttttttttttttgagacagagtctcactctatcgcccaggctggagtgcagtagcacgatctcacctcactgcaacctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctcagcctcccaagtagctgggattacaggcatgcgccaccacacctggctaatttttgtatttttagtagagacggggtttcaccatgttagtcaggctggtctcggattcctgacctcaggcgatccacccgcctcggcctcccaaagtgctgggattacaggcgtgagctactgtgcccggccaagaatgctttctcttaaactttgctgtgcatcaaagaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctcctaaaaaaaaaaaaaaaaaaaaaaaaaaaaaaaaaaattggttattggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttctt

SEQ ID NO: 952 - DNA, 190487 bp, mus musculus
cttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctcagcctcccgagtagctgggactacaggcgcccgccgccacgcccggctaattttttgtatttttagtagagacggggtttcaccgtgttagccaggatggtctcgatctcctgacctcgtgatccgcccgcctcggtctctcaaagtgctgggattacaggcgtgagccaccgcgcccggccttcattgctttattacatgccaaatgcttgtttattgtacaacagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggttttgccatgttggccaggctggtctcgaactcctgacctcaaatgatccgcctgcctcggcctcccaaagtgctgggattacaggcgtgagacaccatgcccagccttgagtgagttattatattcttaatgtataatattgaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggggtttcaccatgttagccaggatggtttcgatctcctgacctcgtaatctgcccgcctcggcctcccaaagtgctgggattacaggcgtgagccactgcacccggcctcctcctctcctctcctcccctcccctcccctcccctcctttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaattttattgttagagtgggggattatgagtcagaaattttaaggtcagctgggcacggtggctcacgcctgtaatcccagcacttttggaggccaagatgggcagatcacttgaggtcaggagtttgagaccagcctggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccaggaggcggaggttgcagtgagccaaaatagcgccactgcactccagtctgggtgacagagcgagactctgtctcaaaaaaaaaaaaaagtattaccatataacccagcaattctattaggtggaattgggaaattctccccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcaccatgctcaccaggcaggtctcaaactcctgaccttgtgatccgcctgccttggcctcccaaagtgctgggattacaggcgtgagccaccacgcccgaccacccatactattttctacctcccagcatttcttcgtggggtgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcaccaagaaaacccagttgaagaaggtgtgccggccgggcggggtggctcacacctgtaatcccagcactttgggaggccgaggcgggtggatcacgaggtcaggagatcgagaccatcctggctaacatggtgaaaccccgtctctactaaaaaatacaaaaaattagtcaggcgtggtggtgggcgcctgtagccccagctactcgggaggctgaggcaggagaatggcgtgaatccgggaggcggagcttgcagtgagccgagatcgcgccactgcaccccagcctgggcgacagagcgagactctgtctcaaaaaaaaaaaaaaaaaagaaggtgtgcctgtttagtcacgagtgggatacaggataaacgtaaatcacctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcaccatgttggccgggctggtctctaactcctgatctcaggtgatctgcccaccacggcctcccaaagtgctgggattacaggcgtgagacaccacgcctggccttacatagcttttagaatatattatctcatgcagttgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggagaattattaagcttttttaccttgttaaaaccacttgtgaggccgggtgcagtggctcacgcctgtaatcccagcactttgggaggccgaggcgggcagatcacaaggtcaggagatcgagaccatcctggctaacacggtgaaaccctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaaggtcatacagcaaacaaatgcaagagccagaattacactgttgcttttttttttttttttttttttttttttttttgagacagagtttcgctcttgtcacccaggctggagtgcagtggcgcgatctcggctcactgcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttgggaggctgaggtgggtggatcacgaggtcagatcgagaccatcctggctaacatggtgaaaccccgtctctactaaaaatacaaaaattagccgggcatggtggcgggcgcccgtagtcccagctactcaggaggctgaggccggagaatggcgtgaacccaggaggtggagcttgcagtgagccgagatcgcgccactgtactccagcccgggagacagaatgagactctgtctcaaaaaaaaaaaaaaaaaaaaaaaaaaagagaagaaatagaatccaagaagtaatctgaggccaaatcctgtgcagttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctgaggtgggcaggtcacttgaggtcaggagttcgagactagcctaggcaacatggtgaaaccccgtctctactaaaaatacaaaaattagccaggtgtggtggcacgcacctgtaatcccagctacacaggaggctgaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttcaaagctatttttcaaaatttagggacacagtcatgatcctctaatctaggattttttttttttttttttgagacagagtctcactctatcgcccaggctggagtgcagtagcacgatctcacctcactgcaacctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctcagcctcccaagtagctgggattacaggcatgcgccaccacacctggctaatttttgtatttttagtagagacggggtttcaccatgttagtcaggctggtctcggattcctgacctcaggcgatccacccgcctcggcctcccaaagtgctgggattacaggcgtgagctactgtgcccggccaagaatgctttctcttaaactttgctgtgcatcaaagaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgctgctgctattattattgttaatagttattggctgggcacggctgggtgcagtggctcacgcctgtaatcccagcactttgggaggccgaggcgggtggatcacgaggtcaggagatcgagaccatcctggctaacgtggtgaaaccctgtctctactaaaaatacaaaaaaattagctgggcatggtggcgtgcacctgtagtgccagctactctggaggctgaggcaggagaatggcgtgaacctgggaggtggagcttgcagtgagcagagattgcgccacggcactccagcctgggcgacagagcgagactccgtctcctaaaaaaaaaaaaaaaaaaaaaaaaaaaaaaaaaaattggttattggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagccacatgtggctattgagacttcaactggggctggttcagctgaggaacagaatttttttttttttttttttttttgagacagagtttcgctcttgttgcccctgctggagtgcaatgtctcacttcgcctcccgggttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttggccacccaaagtgctgggattacaagcatgagccaccgtgccgggccttcatttttttttttttttttttttgagacagagtctcgctctgttgcccaggctggagtgcagtggcgtgatcttggctcactgcaagctccgcctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttctatatggcgattcaaaaatgtgagaggctggccaggcacagtagctcacacctgtaatcccagcactttgggaggccgaggtgggcggatcacatgaggtcaggagttcgagaccaacctggccaacatggtgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagtagaaatctaccacagaaattactaaacttggctgggcgcgatggctaacgtctgtaatcccagcactttgggaggccgaggcgggtggattccaaggtcaggagttagagaccagcgtggccaatatggtgaaatcccgtctctactaaaaatacaaaaaaattagccgggcatggtggcacatgcctgtaatcccaactactcaggaggctgaggcagcagaattgcttgaacccgggaggcagaggttgcagtgagccgagattgcgccactgcactccagcctgggtgacagagcgagactctgtctcaaaaaaaaaaaaattactaaacctgatcacaatcccctataagtacttataaagcaagtcccaaccatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactatattggccaggatggtcctcatttcctgacctcatgatccgcccccctcagtctcccaaagtgctgggattacaggcgtgagccaccatgcccggcctatttactgtacttttaacatatatattgaaatcttactgacattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttgacaccaaagtcatggaacaaaggaaagtaatgagagttaaaaggccgggagcggtggctcacgcctgtaatcccagcactttgagaggctgaggagggtggatcacctaaggttgggagttcgagaccagcctggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctttgcaaactttaatctgcatatgaatcacctggggaatttgttaaaacaggtttttttttttttgagacagagtctcgctctgtcgcccaggctggagtgcagtggcgtgatctcggctcactgcaacctccgcctcctgggttcaagggattctcctgcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgccaccacgcccggctaatttgtttatttttagtagagatggggtttcacggtgttagccaggatggtctcgatctcctgacctcgtgatccgcccacctcggcctcccaaagtgctgggattacaggcgtgagccaccacacccggcccatgactgttttatttcttgtgaacttgatagttcctcttattcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagtgtggaagaaccttttagagatattattgactatgctggcgggccaggcgtggtggctcacgcctgtaatcccagcactttgggaagctgaggcaggaggatcacttgagcccaggagtttgagagcagcctgggcaacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaataaataataaaagaattagtaatcatgagccgggcgcagtggttcacgcctataatcccagcactttgggaggccgaggcgggcagatcacctgaggtcaggagtttgacaccagcctgaccaacatggcgaaaccccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctgcctcagcctcccaagtaggattacaggcatgcaccactatgcccagctaatttttgtatttttagtagagacggggtttcaccatgttggccaggctggtctcaaactcctgacctcaggtgatccacccaccttaacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttcaccatgttggccaggctggtctcgaactcctgatctcaggtggtcctcttgcctcggcctcccaaagtgctgggattacagtcatgagccactgctcccggccaagaaggcagtgtttcaaaccatttcccccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtttcaccctgttagccaggatggtctcaatctcctgacctcgtgatctgcctgcctcggcctcccaaagtgctgggattacaggcgtgagccaccgcgcctggcccaatgccttttattatctactttatttgaacaaaaatggtcctacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcaccgtgttagccaagatggtctcgatctcctgaccttgtgatgcgcccgccttggcctcccaaagtgctgggattacaggcgtgagccaccgtgcccggcctggccatgtattcttaaataaagcagttaggcctttccttgttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtccaggctggtctcaaactcctgacctcaagtgatccacctgtctcagccttccaaagtgctgggattacaggcgtgagccaccgcacctggcctgttaacataatatttagaggttcatgtatcagttgtagcatatatcagaacttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgt

SEQ ID NO: 953 - DNA, 15879 bp, mus musculus
gtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccacacctggctaattttttgtatttttttttgtagagacaggttttcaccgtgttagccaggatggtctcgatctcctgacctcatgatccgcccgccttggcctcccaaagtgctgggattacaggcgtgagccaccgcgctggctttttttttttgagacggagtctcactctgccactcacactggagtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctcc

SEQ ID NO: 954 - DNA, 15879 bp, mus musculus; identical to SEQ ID NO: 953

SEQ ID NO: 955 - DNA, 435 bp, mus musculus
gcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggct

SEQ ID NO: 956 - DNA, 7535 bp, mus musculus
tgtagatgtaattaaggtccttagttagaagttaactttgagttaatcaaatggaaaattacccagggcaagcctgacctaatcaggtgagctctttaaaacgaagtctagagatcacagatctactctctcttgttagcctgaaagaagcaaattttcatgaattctacagctgcaaggaagcaaattccgttaacaactatgtgaacttgaaaggatatccctttataacactattcgccatctcatatgttattttcatatgtaatttgtttattgtctgcttcagccccctccccccatgtaaatttccaagggaagggatttttctgttttattcattgataaatccttcaatgctttaaacagtacctgttacatagtaaatgctaataaatatttgttagataaatgaataaatgaattttaattattgagtttttcatgttccccacaacccttttccactactaactattctctcaccaaattccagcattacaaacttctatccctttcattgagacgtgaattcactttgcactcttaaaaatgacatcctgaaagattagtcccacctctactgagggagtttcaggtactctaaccagaaagttatcatccttggcagatatcttggtttgggggaccagatggacctggattggaatgctagctctgccatttggtaactgtgtaagacctaaagtacattgcttcatttctctgagccccagtttcccctctggagagtaagaatattgtctgcagtcatagggtttctgggaggactgaaagcaggcatgcattttttatgtgaagaacagttactggcataaagatgctatcatactacacacatggctctgtaactcgctattcctatggttttgtacatctatctttacattctggtattttaatttctataggataaattcccgaagtggggttcctggccccaatggtatgtgctttaaaaaagttaaatggtgctggattattttccaaaaaggttttaacaattcatagtctttttttgtgtgtgtagcagggtcttactctgttgcccaggctggagtgcagttgtgcgatctcagctcactgcaacctctgcctcccaggttcaagagattctcctgcctcagccttccaagtagctgggattatgggcgtgtgccaccatgcctggctaatttttgtattgttggtagagatggggtttcaccatgttggccaggctggtctcaaactcctggcctcaactgatctgttcgcctcggcctcccaaagtgctgggattacaggaatgaaccactgtacccggccaatactcttaacaactatgtatgagaacgcctgtttccctgatgcttaccagtagcggatgttaccagtgtttctcatttttgctgatgaaaatagtaaatggaaaaatggtatctcactgtgtttatttccatttcctttatcacttgtaaatataaatatattttaatatttatattcatttgcatgtctccttctgtgacttactttcctttgtccaatcttcttttggatcatttgcatttttcttatcaatttataggttgagagtgtgaggagtgactgctaaggggtacgaacactcttttggggcgataaaaatgttctgaaattagattgtggtgatagtttaataactctgtaaatgtactgaaaacctttgaattttacactttaaattagtgaattttacactttaaattagtgaattttatggtatacaaattattatctcagaaaactgttacaaatgataaaaatttttgaaaagatttttttgagatggtgatttttcatggctgcatacaattcccttttatggagttattgtatttcatttaagcaccctcaattgttttaaattatttccaatgttttactcttataaaaattgtgatgggggccaggtgtggtggctcatgcctgtaatcccaacactttgggaggctgaggtgggaggattacttaaggcttggagtttgagaccagtgtgggtaacatagcaagaccctgttgctacccccaatttttttttaactggctaggcatggtgacgtgtgcctgtagttccagctactcaggaggctgaggcaggaggatctgagcccaggagtttgagatcacagcgatcactccactgcaccacagcctgggcgacagagtgggactttgtctctaaaaaaaaaaaaaaaaaggaaaaaacagtgatgaatttctttgtacatgaatctctgctttttcttaggatatattcttagaataggaattactgggggtgggggaagatggtttttaagggggagatatgatttctttctttctttcttttttttctggtgttgtactcaaaagggaggtaaggttctaataaaaaatttaaaagtagttgatggtgattccatgtcaatctgagtattttggagttttctcgttaagttcagaatgccatattcagcatctcaaaattgttggcctggtccctcctactatggtgacaccaagtaacactatagttggtgacagagagcatttttagttctcatcacacaaatatatacaatttatttctctctttatcatcagttgtttaacttacaactgtctagcaacttactgattgctagaaaaacaagatgagaagctacattgctttccctggctcaaatccgtggggattaggggctaattttagcacagttttaggcaaaagcaggaagcggtgcctatgtggtttcttggctacagtttcataccaccttcacatcttgctaacatacgctggagaaaatacaataataataagagtaataataatgataggtactattgacagataatcataagatccttctttagacagaaaggaacctatcttctccgttagttgtcctaaatactaagaaagaaattcatccagaaggaatgtaaaggaaaagagtttatatctcctacctgttctctagacccaccctcaagccaagcccttttcccatcatcaaatcttcagatttagccaggcaaattgattaatgatggttgattcactgatttccaggacattagcaatgcttgagagaagaggctcggtgttgtcatagggagttgattgggtttgtaataagaatcctgggtttggccggtcttggtggctcacgcctgtcatcctggcattttgggaggctggggcaggcagatcgcttggggtcaggagtttgagatgagcctggccaacatggtgaaaccccatctctactaaaaatacaaaaattagccgagtgtggtggtgcgcgcctataatcccagctactctggaggctgaggcaggagaatcgcttgaacccaggaggcagaggttgcagtgagcagagattgtaccactgcactccatcctgggcgacaaaaaaaaaaattcctgggttttagttctgactctgccattaacctgttatatgtctctgggcaaatcatatgtcctatctggatctaagtttcctatctgtagttgatttctaagggcccttccaagtctcacatgctgtaattttaaggaaacaatataattaggtgtcttccattgaaaagtaaggcagggaacacacttgagagttgaagtcagaggaaagaaactgagtatgtcagaaacctattataatctaggttattttaagttagattcttaagattatcatgaaaaactatgcctttgaggttgcacaactctttatatttactaaaaatcatagaactgtacatgtacaatagtggattttgtggtatgtaaattacacctcaataaagccattaaaatataaatttgattgtcattttatcaccaaataatcatcggcagggtgtatgaaattgtggattgagaatctgctgatttatacacatgcatgaagatgagtgagagcaaagggatatgttaataatcttgggggttttgttggctcagagaagctactgggctccaaggagattgatgaagctaaaatgtcattgtcatatgggaggtaactattgatttcactgacaagccctgtaattatagaacacaatgcctagttacattaattagaagcgagtaagagagtggagctggagccatgctggcaaggagagagggaaagtggagatcaatcttctctaagatgtggctggagcatgcagcgagtgaagagagggaaagctgaaaagtagggtggagattggaaccagtttgaagatctctatgagaaaggcataatacttactactttggattgcatatatattcaataaaattatatattaaacaatattttaaaattgtaaagcactatacaactaaaattatttttaataggcaatacaggcctttggcaaaaatgcaaatggtacgaaaaaaatgatgtaaagagacagtgaaaagtatatttcttccccacctttgtcacccatttactctctacagaagtatccactatttcattttttgtgtgtattcctctggagaaattctattattctatccacatacaaattcatgtatatatatatgtgtatatatgaatgtattttacaaatgacaggatactgttcacactgttttttatttgtatttgtatttacttaacaatgtagctaggagagcactccttatcaacacatatcgatctgtatcattcttttattttttttgagacagagtctctctctgtcgcccaggctggagtgcagtggcacaatatcggctcactgcaacctccgcctcccaggttcaagcaattctcctgcctcagcctcccaagtagctgggattacaggtgtgcaccaccacacccggcaaattttttatatttttggtagagatgaggtttcaccatgttggccaggctggtctcaaactcctgacctcaagtgatctgcctgcctcagcttcctaaggtgctgggattacaggagtgagccactgcgcccggcctgatctgcctcattcttttcaaacacctatagagtatttccttgtactgctatttatttaaccagtcttctttggaggacatttaatttatttcagtggcatctgttttatcttcttaaattaatcctaaccacttaacagcaaaaccagttctcaacatagtgatgaaggtgttggatttttttgcttaatatatcagtttattgctatgttaattttttcagtaagagtaataatcttaatatccccaagactttaaaaaaatttttgatgatgcaataaagagctgcagggaaattcaagcacaattcacttctaaagagctgatttggcctggctaaatatagtctaccaggcagcttgggcaggggtttcaatatattcaggctccaacttggaaggggaacttaagctttcaagaatacttctttgaaagagaagaacccagagaggcagtagaataaagtggaaagatttctggactgggtttggttgctcacacctgtaatcccagcactttgggaggccgaggcgggcggatcacttgaggtaagaagttcgagaccagcctggccaagatggtgaaaccctgtctctactaaaaatataaaaattaactgggcgtggtggcaggtaccacctgtaatcccagctacttggaggctgaggcaggagaatctcttgaacctgggaggtgggggttgcagtgagctgagatcgtgccactgtactccagcctaaatgacagagagattctgtctccaaaaaaaaaaagattcttggggctggagtcagaagacttgagtttcagccccagttttgttactaactggctatgtgaccttgggtaaatcgcccccttttaggggttcagttttccctcatatgttaaacaggggcagaaatagcaaactcctaatgctattatatggactggatgaattaagagagtcacataaagtaccttataaacgttaagtataaatattaccctaagggacagagagacataaagccagactagcttgagctccaggtagaataaatacacgtatgaccacatactgtaacctgaaagctaaaaaatgggctaagaaagaaatgaccccttctcagttagatttttatgcatctggaacttaacaaagagcaaaggaaccctttttggaaaagttcctgtatgtctacagtttaaatgcccatccttgtcacaagctgttggaaagcatattcctataaatacttcctttttttcctctttatagttctctatattacaactcactgaccaaggatataagtccctaactgtcagtgagagtgaaagagaagatttgcattttgaaggtggaaatgctccctatttagatatgccagttcagataaacccaactgtttgtttgtttgtttatttatttatttatttatttatttatttatttgagatggagttttgctcttgtcacctaggctggagtgcaatggcgcaatctcagctcactgcaacctctgcctcccggcttcaagtaattctccagcctcagcctcctgaggagctgggattacaggtgcccgccaccacagccgggttttttttttttttttttttgtatttttagtagagatgaggtttcaccacgttggccaggctggtctcgaactcctgacctcaggtaatccacccacctcggcctcccgaagtgctgagattataggcgtgagccactgccccgggccgatttttttttaagaagaattggaccatttgacatttcattgggaggaaacctagaaacagtgaaggaaaagccaaccagcaccctgtgagagaagaaagaaaatggagagggaggccgggcacggtggctcatgcctgtaatcccagcactttgggaggctgaggcgggcggatcacctgaggtcaggagttcgaaagcagcttggccaatatggtgaaaccccgtctctactaaaaatacgaaaattagccaggcgtgctggtgcatgcctgtaatcccacctacttgggaggctgaggcgggagaattgcttgaacccgtgaggcggaggttgtagtgagctgagattgtgccactgcactccagcctgggagacagagcaagactcggtctcaaaaaaaaaaaaaaaaaaaagaaagaaaagaaaaagaaaaaaaaggagaggcagacagagataaactaagtgtaaattgatacaagatttttggagggcaatttggcaaggggtttgtgtgtagaagacaggctgctatgagggatcagagtcaagcaagttggtgaaggcatccctgtggaggggcagcctggtgtgggaagtcagagcctcagagggctaacaaggacatccgcatgatggagtggcatggcatgggctgttggagcctgagtggaacgaggaggtcatacacatgggggagaggtgatgtagggagccagagtctgagcaggctgcagagggaatccatgaggcagggaggctggttatggagaatcagaggcaccca

SEQ ID NO: 957 - DNA, 1201 bp, mus musculus
cactgctgtctggatgcttctggaaaacccagctctgtcaaggactgaggaatactgcagtggaaactcctgcattttatttcctgagccagaattctgagatgagtatgcttagagactcccctaagatgagcagcatcaaagtctctttaacccttgcctcagggaacagtcacctaacaaagaggagctggggctaagcttctgttttacactgaacagagcagggaagaaaattcatgcatcagggtgctctttagagttctattgtgaaggagaataacttgtttatattaggcaaggccccagtagcttctttgtaaatttcagtctggagaaaataaagccagagctgcaagtccaaacaggtaaaaaaaaaaaaaaaaaaattttttttttttttttgagacggagtctcacactcttgcctgggctggagtgcaatggcgcaatctcagctcactgtaacctctgcctcccagcttcaagcgattctccttgcctcagcctctcaagtagctgggattacaggcacccgccacaacgcccagctaattttttttgtaattttagtagagacgaggtttcaccatgttggccaggctagtctcgaactcctgacctcgtgatccgcctgcctcggcctcccaaagtgctgggattagaggcatgagccaccgcgcttggccccaggtaaaattttgataagctcatgaaaatttcaactagagagttcaggcacccatggctgggatgagggcaacaaatctggagcaacaaacatgcaaccaacaagctttttttgacagcatacttttgtttggcactcctctacgcactgggatacaaatatgagtaagaatgctaccacctaaaataatagatgcctggataggcatagcttatctctggaaggtaacaccagaatgtggtcatggagattacctgtgggtggcgagggaacaggggtgggagggaaactaacttgttactgtaaaccctttataccttgtcaatttggtatccgaggatatattaccaatatattacccattcaaaagataaatgtggtatcagggagacacaaatacgtaaatgtgtaaatagagaagtaaatagcagcatcagctcacaaaagcatgttcacagtgctagagttattgacaacaatggaggaaccatgatataaagactgaattta

SEQ ID NO: 958 - DNA, 1201 bp, mus musculus; identical to SEQ ID NO: 957

SEQ ID NO: 959 - DNA, 498 bp, mus musculus
gcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgc

SEQ ID NO: 960 - DNA, 1015 bp, mus musculus
gcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagt

SEQ ID NO: 961 - DNA, 346 bp, mus musculus
tctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctaggggg

SEQ ID NO: 962 - DNA, 47 bp, mus musculus
ggggcggcagcggcggcggcgggagggggggcagcggcggcgcgaca

SEQ ID NO: 963 - DNA, 380 bp, mus musculus
tggcctcacaaccccggacggcacgcgggtaggtaggctagaacctagaggaggggagcagagcgtgctggggtcttttatcgctctccgcgcagtgcgtgggtctgcggatccgtggaggtgcggagcctgactcggcctccccggctcgcgcgtgagtgcggcggaagcccttctgctcctccacgagttagaggagtgtaggggacgtgcatcccagtgtcgggacgcgagctcgtgctcctcttttcctcctaacggtggcccccacgcacacactccagtccccccgagagttgatcttctcccctcagcgcgcccctccttacccggcccctcccaccggccccccgtttccgcccgcttgctagctgcctagc

SEQ ID NO: 964 - DNA, 165 bp, mus musculus
gggtctgcggatccgtggaggtgcggagcctgactcggcctccccggctcgcgcgtgagtgcggcggaagcccttctgctcctccacgagttagaggagtgtaggggacgtgcatcccagtgtcgggacgcgagctcgtgctcctcttttcctcctaacggtggc

SEQ ID NO: 965 - DNA, 1762647 bp, mus musculus
agacacaccctcctgcttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcctcatctctaaggaggtgagaacaatacggaataaaagccagtttcaacttgggcttcttgaccaagcatttccagttcagaggctctcaatgaactgagctgtcaatgaactgagggtcaggaaagttaaccagagtgttagcacctaaacataaaatagtctcgctactggaggttagcagggcccagagcaagccactccaccacgatctgtacaaaagaccggtgcaggttgctgtgaagccagagaggcctccttgctgaacccttgtttaagcaccaaataggaaaatttgttttctgagactaacatgttaaaaaattctctggattgagtctttttctattctaatcaccagtgaacctttgttttttaagctttcattgctttttttttttttttagacggaatctccctctgtcgcccagactggagtgcggtggcgggatctcggctcactgcaagctccgcctcccgggttcacgtcattctcccgcctc[224 bp omitted]cagctagaaaaacagaaaagtaagaataattatcaccatctcattacccagaggaagctccgtaaatattttaatgtaaatatttacctttctctctttctatgtgtatatatacacatctataaatacacatatatactgtatatatagatgtatacatatctatacatacatatacatacccacacacatatatggatggaaagaaatatacacaaactttttatttttgtttatgtattttttttttgagacaaagtcttgctctttacccaggttggagtgcagtggtgtaatcatggctcactgcagctttgacctttgggactcaagggatcctcccacctcagcctcccaagtagctgggactgcaggcaaacgccaccgtgcccagctaaagttttttttgtttttgttttgttttgtttttttagtagagacagggtttcacagtgtttccccaggctggtctcaaactcctgagctcaagcagtcctcccaccttggcctctcaaagtgctgggattacaggcatgagccacttcgcctggccacacaaacttttaaataatttttttcatttatcagtatcttatgaatattttttgatgtcaataaatacaaatctatataatcatatttaatgactgcctaaattttcattatgggtgtaccagaggtaattatcatttattgtttgatattttgatagtttttctaattttgtgctgttataaacatgaactataaaggtaaatagctatatatctttctttacttttaaatttaaattaattaaaaataatcatatccaggcatggtggctcacacctgtaatcccagcactttgggaggctgaggcaggcatatcacctgaggacaggagtttgagaccagcctggccaacatggcaaaaccccgtctctacttaaaaaaaaatacaaaaattagctgagtgtcatggcgcatgcctgtagtcccaggtactcgggaggctgaggcaggagaatcgcttgaacccaggaggtggaggttgcagtgatctgagatcccaccactgcactccagcctaggcgacacagcgatactccgactcaaaaaaagtaataataataatcagtttctaaatttcacttgccacagttcaagtgctcaatagccacatgtggctagtggctactatattggactgcatatactatatatgcagataaagagcattaccatcagtaactgagtgaatgtctttgagaaggcatcttcaaaattgccaaatcgtccccttaggataaatttctagcagtgaacttgcttgctcaaagattacactgtatgcatttttagtattaaaaattcctcttaaacatactgttaaattgctctacagaaagtagcttcagtttactctttcaccaggagagtgtgagggtgttcatttcccctctcccatgccaacgcttgttagtaatattttaaaaattttttgcagtttgataggaaataaatggtacatcaccgttctaatttgcatttctttgattactcttaaagttgaacagtttttcatgttgattggcctttcatagttcttctgttgaggcttgaatgaatctgcttacagacttatttcctcgtttgtgattcttgcaatacagtctccatcccccaagattctgttttgctaagtctggggtggggcctgcatctgtattctttaaaaggaccccagatgattctcatgtgcacagaaacactcatctagaccgcttgtccactcaaggcaggaatgtcctttccacccagccctgacaaatgattatttagcttctccttaaacacccctgcctgttagagggctatgttagaaaaggttcttgagccgaaatttactgtgtaaatttcaccatgggctagacctagctctgctgttggagccacacgtttgcttccttcctcttttgcataacaacctctcaaatatttagagacagccaccatgtcattttaaaattcactcttcacaaagccaaagaggctacatttctttccttcgttccccacatgacttggtttcaagattcttcatatcattatcatcctgtttgggctcttttccaagttttctatgtcctacttaagatgtgagagacagagcataagctagaggatcagatctggtcttgaacccaacgtctgtcacttgcctgaattgtgaacagacgcaagtaacctggtctcattttccttatctgtgaaatgggaataaatagtagtacctcccttgtggagttcttgggaataacgaaggtaacatatggaaagtttctaatgtataagtgattcataaaggttaaaaaaagagatctggccaaaacaaaacaaacaaacaaacaaacaaacaaaaaaacagtattccagaaggatctgccactgaatacagtcagggagggggcaatgttttgtatcatttctgggtgtgagccgagaagccgggggctgtgtattcatttttattcccagcccagcccctcacacagtgtctggagtgcagtagattcttaggtgttttgtgaaaatacactgccaaccttgggtaggatggactcattgttgggagaagagcctggaggccaggaaatgacttaaaatacagttaatatagttctggagagagataacaaaggcttttttttttttttttgaaatggagtttcactcttgtcgcccaggcacgatcttggctcactgcaacctctgcctcccgggttcaagcgattctcctgcctcgggctcctgagtagctgggattacagatgcgtgccaccacgccccatataatttttgtatttttagtagagatggggtttcaccacgttggccaggctgatctcgaactcctgacctcaggtgatccacccacctctgcctcccaaagtgctgggattacaggcctgagccactgcaccaggcgaacaaaggcttttaactgaggcaatgagaatggagataagggagaagacataagaaacattgtgctgagaaaatcaacaggatttggtgattcttaaaagggaaggagaagggggaggaagaaagagaggaagagcggaggtggagtcaagataattttgaggtttctcagcttgtgtgaactgaaggaaaagcaagtttgttgataggggaagggaaaagaaaatgagcaacttctgtttgagggagttgtcagggcaaagccaggtttcagttaagcaagatggtggctgagcatataaggttgtcttttggcaaaggactagggttctcgagggcagaggtggaaagtgttccaagtgggttcaggaagaagaagagccaggaaaaggccagggctgagtggacagagatgaaattgtaggcgagattagctgattgaagaggtttgcacctttgggggtgattagggaagtgggaggcagggtgtggggaaacgatctggaggccagccccagacttccagttagaatggggtggggatgggaagtgagtccaccccttgggcagatcccactctggggtgggtctgagcagcagttgccctgaggagcagggggtcagtgaggggttgacttcctgctcaggtgctcaggaagaggctaataggatagttcctgcttttaagggagactagaagtacgcaaataacctacagaagatagaagccagataggagtccagtggtcattggtttcccagtcttcaccccatctccgacccccaccccagcccccagtgctctctcttaagatccttaacgtttttcaagactttcgtcctttctgggttcgacaaggttaaataggcctttactaatgaacattgttctgtttatggcatttcccacatttatttgaccacagaccctgccccacccccaaccggctttttatggaaagtggagagtaaatggtaacatctaacaggctgagaaattcctatatagtgtgcgtgtgtaactaactcatcttggcgttctcttacttgacctctgtggattgcaagcagtggttgctactttcccatgctccacgtcaagaaccacccttgctgttcagttcagaggagtaattcacctgtctgattgtgctttctcctgagctatagaattgtcagcaagtcatgttgaaagacgattagtttttaaaaataatttgtttatcatggaaggggaggccaaaactacatgagggtacagctcgagccatttcttctgtaaatcctaagggtacttagaatacgtttctctttgagatttacccctcttggtttaatttttatcaggcatgcagaggagttggtgggtaacattggcctgccgtttatatcagcctacagccagatgcctttttgattccttgcaggaccccaccctggacgctcccagagcagtagcttgaatggagcaaagagacagtctcagttagctgccattgcctttgtaagcttgtgcttcagagcaaagtggttaagagcttgggctctggaagcatgctgcccaggttcagagttcagccctagatgaccttgggccaattatttaaccttcctgggcattggtaaccccctcaggggcttgttgaaaggcttaaatgagttatttgttttgttttgtttttgagacggggtctcgctctgtcacccaggctggagtgcagtgacacgaacttggttcactgtaacctccgcctcctgggttcaagtgatccttccatctcagcctccctagtagctgggactacaggtgtgcaccaccattgcccggctaagttttgtgtttttagtatagagacagggtttt[138 bp omitted]gaaagcacttcaagtggggtttgccaattgttaagtactgatgactgttggctcgcattatcatccccaggctttatggtgggcaagagacgtcttttgtatatgtgttacaagtcagcagacagaaaagttaactggaagaggggaagcaggtacccttgctttaattccttgctccagatgatgccccaaaggggtgagccacatggctgatccaagaatcttacccttcctggaagaacaagctggcagacccctctgcatgaggttcttgccaatacccgttcccagtctgacttagtcatactgaaaagcctagtggatggtagcaagggttctgggtttttggcattttctaccttcacacgagtttaatgagtgagtgggaaggctggtcctcaagtggggagaagcactctgtcctgtgccttgggccggaaggctctccagactggggaaactgtacctgtggcctttggcagaagcacttacctttatgccagcctgttcagtgtgatttatgcaaaggggtgaatagaagagaattgggatctgtgtggaaaaacagagcttggacatgcctacctttccctttcaaaccttcactgatgccaggcacgttagcctatgcctataatcccagccctttgggaggctgagctgggaggattgcttgagcctgggagttccaggccagcctgggagatacagggagacccccatctttacaaaattaaaacaaaaatgagccaggcgtggtggcacatgcgtgtagtccagctacttgagagactgaagtgggaggattccttgagcccaggagttcgaggctgcagtgagccttgattgtgccactgcactccagcttgggtgacagactgagaccctgtctcaaaaaaaaaaaaaacaacaaaaaaccaaaaccaaaaaacctttattgttatccctttcactcttaatcctcacatttaatagtcaaataaatattgaaatgcaaatgcttttttaaagttctattttggggctgagcgcggtggctcacacctatattcccagcactttgagaggccgaggtgggtggatcacttgaggtcaggagtttgagatcagcctggccaacatggtaaaaccctgtctctaccaaaaatacaaaaattagctgggcatggtggtgcacgcctgtaatcccagctacttgggaggctgaggcatgagaatcacttgaacccgggaggcagaggttgcagtgagctgagatcacgccactgcaccccagcctgggcgacaaagtgagactgtctcaaaaaaaaaattatattttggaaacatacgttttaataggaaattttaaaacttaaagctgtctcgagaaattattcttttatatttggctattctggttttgtggtagcaggataagttctgttaaggatagtgtgtggctgggcatgatggctagtgcctaaaatgccagcactttggcaggctgaggtaggaggattgtttgaggccaggagttcaagaccagcctgggcaacatagcgagacccccgtctttccaaaaaaataaaaagaatagtgcacacaggttcctagcagagtcagtacagtggaaaacatgccgagtgttccagctctacgtggttcatcttttgtctgtgtgcagccttgcacaatcatgcctaaatttgctattaatgatttcctgcgattcttctccacttttattgcctattgagtttattgttcatgggaagttatgtgcttttgccgtttttgacttctgttggattgtgtatatgtttcaagctgctaagaaatgttagaagatattctgatacttcagcgttcccatcgcattgctttccctaatgactggaaatattttactgggtaagatttaactgagaagtcaagtgttgcttccaagtctctgagacagaacatctttatttgaagtgtttcagtgaagtgtgtcagaaggctggggaattcatttgtataagattttttttttttttccggagacagagtcttgctctgtcacccaggctggagtgcagtggcaacctccgcctcctgtgttcaagcgattctcctgcctcagcctcccaagtagctgggattacaggcatctgccaccacgcctggctaatttttgtgtttttagtagagacggggtttcaccatgttggccatgctggttttgaactcctgacctcaggtgatccatccgcctgggcctcccaaggtgctggaattacaggcatgagccaccgtgcccggcccgttttttaaatggtgacaagaccttgagtttttatagccgaaatcttaagacttaaaaatgctgttatatctatctgtggcctcatatgtctacaggtcactactgaacacatatcacatagtcatcacccctcttctgtaagtggggaaacagaggcatggttttcagtgaggcaggccataggttatttatattaatgaaatgacagagcaggtaatgaactccaggtgtcctgattcctttggagtaaccatgtgaagaaatactagagggatgccagattccacagtcaatcaggtggagaaagctctttctgtgtggttttggtgatgatctcgctctattgggaaacagtgtttatttctaaacaagcttaggtctctttagtgggaaagtaggaggtgaggacaaaaaaaaaaaaaagagggatggggttgttattgagaaatgtgggcaagatcagtatagatttttgcttgccaaagtaagcctaaggatattgagaactgtttgcaattggccatccctccttactttgctatttgaataactatatggaaaaaaatatccagaacactggctctgcagaggtacctgggatcattttcatggaactgttttcatgatttttttcaagtgggttagtgctgtccaaaaataacaacatatatatttctttccatgccttttatattagtagtttagttttcccacttgagaaactgccagctttatgccttgcagggcctgttgtcacagtgttcacggtgtgaatggaagagtgctgttggcatggccagtttactttcataggtgaacacgttcctaatgcttcagtacattaaatcgtttcctagagatctgaaggagggaatgctaccttccaaggtacctaccttcccaccaagaaataacttaagttcaagaaggttctaaatcaaccggtacatacatggaactgaatcgttatttcaaagctcacaggggccaatagctctcgttgtgtccagccgagtgtttacgacatgctctatagtttgtggagcaaagaaagccctcccttgctaacttgaccctggggagacttgctcctctactcctagtgaccgacatgaccacttgcaagggaacttggcctccgtctgtccctgctaaatggtctggcagaattctcatcaggagagccagaagaaaattccataaggcttctcgcttcagttctgtaataacaaacccagctccctctccctgcctgccctgcttcctttgctcagtactgcccctaggctcagagacatcagggagtctcatattcagagcccaggttcttcaagtccataggctgctggttctgccctgcctttaaaatccatttccagtcaactggatttggatcttcttgtccccttgtgtctttgtctcactcactgtatctctgtctggccccctagcctgtccatagctaaccccctgcctcagttttctggctaatcgcccagttcctctaggagtaagttcttgccttgttgctggccttcctgaggaggggtgccttaccctcaccaggaccatatgactgagcccagcacagtggaactgtggattgaaggggtgagtttctctctttttttttttctggaaacagagtcttcccaggctggggtgcagtggtgcaatctcggctcactgaaacctctgcttcccgtgttcaagtgattctcctgcctcagcctcctgagtagctgggactacaggtgtacaccaccactcctggctaattttttgtatgtttagtagagacggggttttaccatgttggtcaggctggtctcgaactcctgacctcaagtgttccaactgcctcggcctcccaaagtgctcggattataggcgtgagccactgcacctggcctggaggggtgagtttctgcttagagaactcagaggagacaaagtgcctgggataacgcagtccagcaagtggccctgttgaggactggactagctttatggtctattagtttcctattgccactgtaatgaattgccacaaacttagtgtcttaacacagatgtgttccagttctagagatcagaaggccaaaattggtttcactgagctaaagccaaggtgtccaaaaagcctcacttcctccagaagctgtaggggaggatccattgcctggtctcttccagcttctagaggatgcccacattccttggctcatggccccttcctccctcctcaaaccagcaatgactggtcgagtctttctcacatcctatcagtctcacactgcttctgtcattatatctccttctctgacaccggctctcttgcctccctctttcacttataaggaccttggttccaccttggtaatctaggataattgccccatctccaaatccttaatttaatcatgcctgcaaagtcttctttgccatgtaaagtaacatattcacaggttccacggattaagatgtggccatcattgaggaaccattattctgcctatcacgcaagatgtcacccaagtttgaggactgatggaatcctggggtcagaggggttcccagcacaggtcctgacattacagtggaggaggaacagggatctggcaaacagccaggcgcagaagtcttcatagaattcaaatgaggaagcacaatcccttttgcgaattttggctgaaagaaagcaatacaggtctgcagtctgcaatttcaattgacatgttttcttaaattcttcataactaaatgtctttccccacacaggactccctgagcctggagttcttatagcgggcactgctttcagacttgaggtgttttaggatacaagctgggcagacactttgcgggcatttagccagctcaggcctatagaattttccaccttcagttaaagaaaagagcaaagaggtaggggtgtgtgtgggtgtgtggatgtatgtgtgtggcggggggtcagcggggaggtgtttaaaagagaaagcgatggttgcacatcacataaaataactatttggccacaagtcccaagatacctctcatatgtcctgtgtaagagatgctttgcccagcctgaaggtcaagttagactgggcatggtccttctgcattttcaaggtaatcacagaatcccttcccagaaatggctttctaaaacacatgattggagaagcagaaggaaggactggaaaatctatctgagttctttctggcttcatgatgatttcaattaaaagataaatggaaacttcccctctctaccacatctagtcactgccatcttagagacacatagaacaaaagtttcctggctgataacatttgcatcagccctcctcacactggccagtatgatgtccatgatgtgtctgatggcacagagctttgctgtcctgaagaagcactctatcgtagatgtggattgcatttcctatttttaccttggttctaattggccacggccatatttctcccaggcccagcatatcttttttcaagcctctggctaattgacctggctgtaatgcactgaaaatcattatagaaaaggttggggaaactcccagattgtgtttgaaaatctgtagagacaaaatacacattcactatcttcacttttctcctgttctattttttctttttttcctcctcaataggaaaacagtttcaattctccttataaaccatctcagggtaaatattcagatgttttcagtggaattatgttaaaccattttttgaaagtgcttatctacgatgaatatctactaattattaaatgtgaaagggtattaactgtagtcctatttaaatcttttttagaaaatggtgttcattttctgtaaattgtgggtttattctcttcaacctggcttatttgattttattttgcgatttactactttctgctttggagtttctccttttctctattggctgtcagctgaacttcaccgaggcttctgggtactgtgcattaggtcaatgagcttcatgacagagttgacgcctgggaaccctggaacctctggggctgtgttatgcagcagaaggaactagaaaggaggagggcgttgctggagagtgagctagagagagagaaagttgtgctgagctgtggaagatggctcccctggctgagggagaagacagataccgtcgttcagttcatgctcaaatcccaagggaaatgtttgtgaactgttgcttgaattgaagagaagcagagaatctatttccgcttatttatttatttattttttgagaaggagtctcactctgtcgcccaggctggagtgcagtggcacgatcttggctcactgcaaccaccgactccggggttcaagcaattctcctgcctcagcctcccgagtagctgggactacaggcgcacgccgccatgcgtgtattttagtaaagacagggtttcaccgtgttgcccaggctggtcgcgaactcctgagctcagacaatctgcctgccttggcctcccaaaatgctgggattacagcgtgagccaccatgccctgctccgctgatttctttttaacagatcaaacctacttacgacaaggaggtaggaggaatggtggaaggcaagaccagggcttaatctcaagaaactgaaggattaaaaaggggcaaaaggaaggtattttttttccattacaaagaccaagagaccagagattaaaatattaacaatatttaatgagtgcagccgtatatttttagattcagacaggaagagatcaagtcctttagaaattgtgcttgataaatgaaacagttttgtctggcaccaaaggggtgagtagatacttattcaggggctggagacagtgcatatactgtcaacttgcatgatgcaggacctcaaatcagttagttaaggaattgagaaaatacttgtatgccattcagcatataggatagttggaacatagggaaactcattctccaacttcaatggaggtcagagacacatgaccatcagacacccataggggccagatttctgttgggagcccagggtagagggactcaggtgctaggtctgcctgccctccttttttccatcctatcctctaccagggtagaaggggagccaacagctcatgcctctgccagacccgtgtttctcaaggcagaaaacgctgcttgacaggaatggtggccatagaggctgccactctgagcccttgtgaccttctctgagagcagcccccactgggactggcttcttcttactgactacattctctttcttgcaagctactatcttcccctttccaccttctactattccctaactgctttccccccattctgattttcctcaactgctgctcctggtgtttgcctctgcactgccaccttccaggaaactcttctgtggatctggctgcctgatccagctccttgacttctcccttctaccatgccctgggaaccattgtttgactgtgggcacactccttctctccccttctcatctttttctcacctcttctttctctctcctctgtttggctaaaaagtgtgctttgtggcacagagccatcactgtgtttattttttttaaaccttttctttagccaaggatggaaaattccaaaggcctgagctagtgatggctggatgccttttctggaaatccagtggcctgggtgccaagggaatgttgtggagctacacatctggcaaggttgtcccctaaaatgtcctggctttggatttagttccaactgaaagaaggggaggttctatctggaattatggaatcagaatgaagagttagctaggtgtggtggcacacgcctgtggttccagctactcgggaggctgaagcaggaggatcacttgaacccacttcaaggccatggtgaactatgattacaccattgtactccagcctgggtgacagagcgagaccttgtctcaaattttaaaaaaaagtgaagagtttacgaaattatgtaattgtaaccccagagcccagtttatgtcactgtttttttctgctgggtttaattgggaaagagtggcctttgacttagtagatctttaaaaagtgaaaccttttgcatgagagtcaaataaagttcttgcacctcagtttaatcgatgattttgcttcgttggggttacttggcagaggccaggcacacttcagagcacctggagtgggccttatgggggagcagcagcatcattccagttgttaccaggtgcagttgagtaggcctactccaccttcatgtttcttgccccctcttggagaaataatgatatggtttggctgtgtacccacccaaaaatctcatcttgaattgtaatccccataatccccacgtcaatggtgggaacaagtggaggtaattggatcatgggggcagtttttctgcatgctgttctggtgatagtgaatgagtctcatgcatatctgatggttttttaaacgtctgacctttcccctgcctgcactcactccatcctgccaccctgtgaagagggtgcctgcttctcctttgccttctgcctggactgtaagtttcctgaggccccccccatcaatgctgaactgtgagtcaattaaacctctttcctttataaattacccagtctcaggcagttctttattaggagtatgaaaatggactaatacaaataatttggccagagttttgtgcacacgttcctgcggggtgaaacaagtcagagttgaccaccttgatggtaagcaaaaagttattgtcttgaaatatctagaaactgtaccattctcctacctcttgagagcgtgggggagattaacaatacccaaacccataaaaatgccaactctgtctgcactggcttcacattgccataaacacccagatttcctagaggggacttcatggcccttcatgtccaccagtaaggaccatcccacctttgaagtttcttctcccaccacacccttcctttgccctgtagtctagccacattgaaccatcacactttttcaaacacatttctatagtttctcacctacatacctttgtgcatgctgactcctcatccggggatgcccttacaagcccttccctgctaaagggaatcctatctgtccttcagggcttaggtcaaatggccatcttctccatggccaccatatttggagctaattgctccttctgcagccttacagcctcttactagttgcgttggcttcctgtggctgctgtaacaaattaccacaaattgggtggcctaaaacaagtttgttctctaacagatctagaggccagacgtctgaaataagtatcactaggcctcactccttcaggagattttaggaaaggatcatttattgcctcttccagctctggtagctaccagcattccttggcttgtggttgcatcactccaatctctgcctctgtggtcacattgccacctctttggtctgtttcaggtctcccgctgcctctttcttatcaagatacttgtgatggcatttagagtccaccccaataatccggatgcgctcttcatctcaagatccttaatttatttcattttgttttgttttttgagatggagtttcgctcttgttgcccaggctggagtgcaatggtgcaatctcggcttaccgcaacctccgcctctcgagttcaagcgattcttctgcctcagcctcccgagtagctgggattacaggcatgcaccaccatgcctggctaattttgtatttttagtagagacggggtttcttcatgttggtcaggttggtctcgaactcctgacctcaggtgatccgcccgccttggcctcccaaagtgctgggattatagatgtgagccactgcacccagccaatttatttcacgtctgtaaagaccctttggccatatatcatttgcaggttccagggatgaggatgggggcatatctttttgtgggggaggcattttttcagtctgtgtgttcttaggttttagagaggattgatatcagtactttcattttagagaggattgatttcattaggcctcctaagatagttgttgatagcttctctattgtattagaatgtaaataccttaaggggctggtaggagactagaaagctattgcttagtagtcagtgccagagggcccagcaattctactgacaatctgtgttaccttgggcagactgtttgacttttgggggatctccttttgcttatttgtaaacattggaagaataacatgaacatcaattggccttgcaaatatgtttataatagcaaaaacaaaaacccaaaaaagttcacctaaatgttcaaaagtaaggatttgggcaaatatatatatatatacattcttacaccagaaaactgtgcagtccttaaaatgacattctttctttcttttttcttttcttttctttttctttttttttttttttttgtgatggagtctgcgtctgttatccagcctggagtgcagtggcatgatctcgactcactgcaagctccgcctcccgggttcacgccattctcctgcctcagcctcctgagtagctgggactacaggcgcccaccaccatgcccggctaattttgttttgtatttttagtagagatggg[145 bp omitted]tttttcttctttctttctctctccgcctctctcacactcgctctgttgcccaggctggagtgcagctgtgtgatcttggctcactgcatccttctccccctgagttcaagcaattctcctacctcagcctccctagtagctgggagtgcactaccatgcccaagctaatttttgtatttttagtagagatggggtttcgccatgttggccaggctggtctcgaactcctgacctcaaatgatctgtgcacctcagcctcccaaagtgctgggattacagacgtgagccaccgcacccggctgacatctatatttattgacagtggcaaaaaatttacattatgaaatggcatgcaaagtatgatcctatttttataaaataatgcatatacgatatatgtgaatatacttacctaatcactctgtgcctcgttttcttcatctgtaaaatgtagataatgatagtactgacctcagaggcttgttgcaaggtttgagtaaaattagacattgaagcacgaggaacaatgcctagcacatagagaagcactgaataaacgtagctattagtattattgttatattcaaaacaacattcccaaaggatgttgtatgttgataacatatgtttatatataatgcgtatatgtgtgtataatattaagagtgctagatgggcacactggctcacacctgtaatcctagtgactcaggaggctgaggtgggaggatcatttgagcccaggagttcgaggctgggcaacatagccagacccctgtctcttaaaaaaaataataaaattagctgggcatggtggtgtgtgcctgtagtcctagctacttgtgagtctgaggcaagaggattgcttaaacccaggagtttggggttacagtgagctatgatcgcgccactgcactccagcgtgggtgacagagtgagaccctgttttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttgcgtatctcagattctctgtctgctagatcattaaaattaggatgggctagagattagactttaattcccacttgcatttaattcctatcttcttaagtattattccctgaactttgattataatgtgttttctttaaagtgaaattttgaagaatatatgtatatagtcttacactagatatttgcctgtacatccacatatatctatatatttcatattatctttataattttggggaggcctaagtgcctactctgaattttctgaactgtaaattaaaatagctgctatgttgcgtgtgaaatgtatctcaggttgttgatactggagttctcttttgctgccattaagaagatgaatcactagagggacttaaatttcaagtaaagctaattaatttgcattgaaattgcaaggatttgtggtcatgatttttctgattttgaacatgctgaatctttgttcttttatttaaaataatctttatacttctcatggatttaaaaacaaatggatgggagaattacttatgaattatgagctttgaaatggaaggtcttgcctctgacatttaaaacaattagattatgatgcgcatcttggtaggcaggggctctttccctctctactgtgtgcctcttttttctgtcagcatgcatgtccttgagttcatttctttcttccttctgttcttctgtcttctctctactatatgtctctttttcttacaagatatataaaaatgatttgttacgtttggtggtctctgcctgtagtctcagctactttagggagaccaaggcgagaggattccttgagcccaggagttcaagtccagcctgggcgacatagtgagacccccatctcttaaagaaatggtttgttgtatttaaactgggatttggatatttcctctttgtaactgaaaaagtagggcaaatgaagggatgaataagtgaagcagagaggatttttaaggcagtgaaactactccatatactactgcagtggtggatacatgccattatatatttgtcaaacaaaacccatagaatgtacagcacctagagtgaatcctaatgtatcctatggactttgggtgttatgatgtgtcattgtagggtcatcaattgtaacaaatgtaccactctggtgcctgatgttgatagtaggggaggctgagcctgtgttggggcagggagcacatgggaactgaactctataatttctgcttaattttgctgggaacctaaaactgctctgaaaaatagtttatttaaaaaagtaagatctatgaaatttttttttgtcaaaaaatatcctaagtgtagttcttttgcatttccgtggacctttaatttttctgcctgtcagtagtcctaatatttttttaaaaaaactttttgtcccatctcgataatttggaagcttgcattcccagctctcttgctgacttgttcggcataattatggagacttacagcaaatgagaattgaatacttcgaaggctttgaatgaaaggtgccaggtaaaagcaaagcaatttt[131 bp omitted]tggccaacatggcgaaaccccatctctactaaaaatacaaaaaaattagccaggcgtggtggcacacacctgtaatcccagctactcgggtggtggaggcaggagaaatgcttgaacctgggaggtggaggttgcagtgaaccactgcactccagcctgtgcaacagagcttgactctgtctcaaaacagaaaagaaattttaaggtctgctcttcactgtgtgaccctggaggcaaggcgctgatgaaatgagtatgtgaaccaccaaaatcatggtgaagaggtacctgctaaccaaattcagactttggagcagctgtgtttcctcaatgtggcccatatgtaaatcaaatttgggcaaatcacgtcatttcacatacacttggggaatctgatttttgaatgaactttattggaatcctttggaaaagcaaagcataattttgtaatgcaagtaaccatccactaatttatatttttttaaggcagggttttgtgaggtgggatttcagtttttgtaacacactgtcactcctctgccatttaaaatcagattatacctgggagagaaggataactctgggaagttgcattaactccttcagacctgaagaaggcatttagtcaattattgtttctgggaactaaataatacccttgtcactcaaaaaatttaaaatagcctttgtaagtggctcctcagtctctaagagaacatgactcattctttctttgtaacttgaaagaaatccaagtgtcagaagacactgggaaatggacttaagttacacttctaaacatcagtactagagatcttaaatattaggaaaccaatatgatattggtttaaagttgatggttggagccactgtattaggatgaaagggcaagggattgactggcagtgctttctagaatattccttggggaaattcttgctggcagcattaaggctcctgagctctggctgtactctgtgtaccataggctgtcctgttcttttgtccagaaagcccactccctgcttttctaactgcctcatggttacacatggcctcataatgtttcttctgccagcttaatttatggttgctttcccctcaagcagcctttggatccatcttctgcatataaccagtgaaaagaaacggagtatattagaagatgccttgcattagtgctgggagatggattgcattcctgtacttcttaaaacccatgtccttgataatacaagatggagctgtggagggtgaggttctccatgtctgggttcgcctttgcctttcattgacctcggtggctgccagtcaatggaaaaatatgatcagggttcaccctatggaatcattgcttaatatcatagatgactcattggaattagtgttgttagaaaatcacttccagatgtggagcagaaacttttccaaaagagagaaatacactctggaaaactgggttttattatttttttaaatgatcttagggccagaattaaatctgcttgtgcgtggttagtcaacatatatttggagttctaagtagtacaatcctgttcacttcctttagactgacatccacataagtgggggctgcctttagcctgcttccttatcctctgtcaacttctgccctctccacatctcccatcttctcacagtgatgaatggcttggaagccttatctactccctcaggttccggtctctcattccttatcattaccagcaaaatttattgagcattcctagatactgtgaaggatggaagaaacatctagttggaaagcaatagaagttttggtcatatagctaagtgactgagaatgagctctggtgtccacttctgagttgaaatgccactttctggctgtggaatattgggaaacttactcaacctttttaagtcccagtttctttgtttataaaataggagtgatggtgataatcatacctaccgcataaggtaagcatgaggcctaaagggataatccatggtcaaccctttgcataggctaagtgttagctattattattcatcaattcacctccgtgtgtagtttttgtatgaagggggaacatgaaccattagttctagactgacactctccaaaaagcaaccacagtgtttgaattttggaattctctttaagtttatttcactgcagcagagaattcactggcttctcatattcactacatttttagttgtgccctgttaaaagagggaatgtgttgtcatctccttggaagcaccacatgacagactttgtagttcacgcaatagtcagaaggaaagtatttgtaaatagcataccctggagctcttgcaaaagccacgtctattctaataaggtgtttttggtaaatgaaatcttatgttttccatcctacttatttttcacaacgtaacctattatcacattgtatttgagtagttttctattgaatatgtattctcccctccctccatctcaaatgtaacatatcaataagtgtgtttctatactagaatgtggtaaaaaaaacatttctaaaacttgaaaactgcactagaagaagaaaatatcataaccattcctattacatagagatttacattaatatctttactctttaaagcattgaaaatgtttgggaattcacaaaactgctgcagaatctgctgtagtggttaagagcatgcacttggccaggctcattcctgtaatcccagcacttggggaggctgaggcaggcagatcacttgaggccaggagtttgagaacagccctgccaacaaagcaaaaccccgtctctactaaaaatacaaaaatttagctgggtgtggtggcgggcacctgtagtcccagctactcaggaagctgaggcaggagaattgcttgaacccagggggcggaggttgcaatgagtgatattgcaccactgcactccagcctggggtcagagtgagactttgtctaaaaaaaaaaagcatgcactccagagttaaatagagcctggctttgaatcctgactatactggttttctgttgctgcatagcaaattaccacatacttagcagcttaaaataacacacttattatttcacagtcagaagtgtaggcatggctcagctggattctctgctcagggttttacaggtgttggcaggactgcattcttatccagaagctcagagcttttccaagctcattcaagatagcacaatttggttccttgaagtagttgaaatggtcccattcagctgggggttgctgtcacctcctagaggacatcctcaggtcctggacagataggcctctcatcatatggcagtttacttctttaaatccagcaggtgtatctctctcttcaggatgggcccagttcctcttctagagatcacttgattaggtcgggcccacctggaatcctctctgttttgattaactcacagtcagttgattcctgacctaatcagggtagggatatctctcaatattcacaggtcccgcttacattcaagaggagaattaaacagggtgagtagaccaggaggcaagaattctaggggcatctcagaatttggcgtactacgctgactctatttgctcacttgggcaagtttctgacctctcttaatctgttttcccattgataaaatgtgagtagtgatagtattctctacctcatacagtcattgctaaaattaaatgaggtaacgcatgtaatgcatttcgcatagtacctggtgcttagcaagctttcaataaatgttagaagcataatagagaagagttacatttcttcctcctgtcctacattttctttcatttccccaccctcataatgaaatggctttgagggtaggacatatggtcacatgctaaagaagttgagtttttgcccttaggatttgaattaaatacaaaaaagaacttactgagcataaaggttgtttaacattgaaatttctaagccatttgtatgtctaggtggagacctttctagaaatatccttctcattggattcttggttaaatgaatgcatgtgcagcaggcagttcatggggttttaggtgtgcttcctaggtaagaagattttaggttatttactctgcttatgaaaagacagtttggtaggttggtgatctgtaattgtcaatacctttcaaaaacaaatcagtactttgtagagcgagaaatttcagtttacaggacctgcactgtgcactgtgtttctcacgtttagtaaggatattcaacagttcagcctcacgatagtcctgaaatttggactgagtttattcacataagctactgagacacagccatttctagaggatttgagtatagttccggggctattcctagaagaaaatgaatatgtattgctttttctcattgcctgtgtaaattgatcatactcaataatacttagaaaacaaactcccatgtgacaaatagttggttcgaaggcccattttgcaggggggactgaagagaaaggaaataaggggcagagagacaagaaggggagtttgatcctccgagatggaactgaacttgggtgtcacttttcacaataattactcaagcattcctctccattcagtagtgacaaatctgcatgtttgtcttctatgtgagaagtttggaagtttgagtgtgtagttaagaaccagccagaaacagagagctggtagggctgaggaatcgtataagcctgtaagatctatgtcctccccaccctgcctgtttgcccttgctgggctcactaccacacccagatgagtttcctttctgtgactgtcattagtacacaagtgccccaccgcattagctgcctaaaaaggagccaagttgggggacgattgatgagtttgtgacctcattgagaatacctcagttcttgttccttcacccacagaagggtaaaaaggaggtattaggcgtaccttctccatccatatttcaggctgtctgtttgctccctaaaaattcaacccataccttctttaaaaaataaagttgattacattaactttatttgtcggtgtcctctgatttttttctcaaatcagaggacactaacaggagagtaaaaaggcaacccacagaatgggcaaaagtatttgtaaagcatatatctgataagagattaatgtccagaatagataaagaactcctataatgcaacaacaacaacaaacttgatttaagtcaggcaaaggacttaaatagacatttctttgaagatgataaacaaatggccaataagcacgggaaaagatactcaaaaccattagtcatcagggaaatacaaatgaaaaccacaacgagataccacctcacacctgttctgatggttgttattcaaaaaactggaaaataagtgttgaggaacacgggcggggcggacctggaacccttgtgcattgctggtgggtaatgtaaaatggtacaaccactatggaaaacagttaagtggttcctcagaaagttaaatatagaattaccatataatagactgggagaggtggctcacacctgtaatgccagcattttgggagaggcaggcagatcacatgaggtcaggagtttgagacaagcctggccaacatggtaaaaccccatctctactaaaaaatatgaaaattagctgggcgtggtggcgtgtgcctgtaatctcagctactcaggaggctgaggcaggagaatcacttgaacccagga[135 bp omitted]cccaaaagaattgaaggaagggactcagatacttgtttcacaccactgttcatagcagcattgttcacaattgtcaaaaggtggaaacagcccagtgtccctcagcagatgaccaatggaatattattcagccttaaaaaggaaggaaattatgacacatgctacaatatgcatgaagcttgaggacattatactaagtgaaagaagccagtcacagaaagacaaattttatatgattccacatatatgaggtacctagaataggcaagtacatagagacagaaaatagaataaaggttaccagggatgggcgggggcggtgtggaggaagtgcagagttgaatgcgtacagagtttctctttgggatgatgaggaagtttggaaatgggtaatgatgatgattgcagagtaatgtgaatatagttaatgccaaatgcagacacttatatagtatatacttaacgaagtatatactttaaaatagttaaaatggtaaattttatgtatatttttaccacaataactaaaaaaaccaaattaagttgattgtatgttttggattataccagcggtacttgtttgtgctagaaaactctgggggaaaacagaaaaggaaaaaaaaagaaaaagaacgtaacacctccatttggaatacataaatctttaatgttttgatttgaccatgtttctttttaactaccctccccttgtcagcaaaaatgacaatcactttctaccacttcccgtataggtggcaaaatagtgcctacttattccctgtgaaatttccatgtcttaattcacaaacagaaaagaaagaagaaagacctgagcagtgaaaaacatcgcttccctgctgggcattctgttgtaaacctatccttagcaaggcggtagttcccaggccatgacatcttgggagcagctaccaagacaagcacaaggacctggggtcagcaggtctggcttccagctccagtcgtatgaaagatatgagccagggctttcaagtcttcagtcattctcacatcccttactaagccacagagcaacatcacatttagccatattgaatcaagtcctcctcataccgagcatggctcttgcttcagagatgtgaaggctgttatctcttgtttcctctctcagctagctgttctgtcaatggtctgtccccagggcccttcaaaaggaactctggccaagggtccctgagggagagaaagatgccagagttttacaagggctgcctttgcctgtttgtccgatgactacttgcttacagtctgaacgtgagtgctctcaggttgtggtgtttatgagaaagcaggggccagcccctgacctggccagagactgtagtttctacagtagtgccagtacattcctgggttctgggaaactttactgagctaggcccagattgctccctaagagaaacctcccaagggtcagaggaaagaggaaaaggctcattgatttaacagaggacagagtgactgatagagaaaaccattaaacatttcaattggcttttccttgaattttagaaagggacttatttgttttcccactggaaaatgggatattatttaaatatgggatgaaaattacattggaaggactggacttaaatggccagaagtccttcattgatccaagcaataatcctgttttgccagaattctctcaatagtgaaatatgtaagcagcagtgaagtaattacaccaatcttcctccttaaacacgatgggactccaaaaacatataagtgatgtcctttgaattgtcacccaccacaggaggccacataatcactccctaatgttttcattgctctaaaacccaggaatttccatctgtaagtttatgattcgtgtgagatacccagggcctttactatatagttgtatttcatgtactgtatatacttttatcattagatgagtgtctgcattttggtagtaaaggaaaactaccatttaaacaaaacaacttctactggttttattgtgtctctccaagactataattacatctgctttttttcccaattgatatagatccagtcattttacgtgaaaagatactctttcttaggctggggcttcacatagcctgttgaaatccttagaatttttaaacaccttgtgtgaaaacttagttaagaatttccctctcttacttttggagcaacaaatatttgttggtggatacatcttggaaatcaaagaggtttttgaactctggtccgaggttccttgtagtcagaaatttctcttatattactgggaacaccgtaactgctagaaatcaacttaatcagcagtatgaatccattttggaagaagaaaaaaatgaaaagagatggagaacatcaaaatgttaacagtggtcatttatggatggtggttttccaagtgacttatattttcctcattatatttttggattaaaaattcttcaacaaacatgtattgtttttataattatacaaaaccaatacatcttatatgatgacaaggcaacctgtttatatgaagctagtaaggcagtagattataacctttcttgggccacacactcctttgagattctgggaagctgtgaaccctctccccaaaaagatgtacatatagcaccttccatataattttagtagtttcacagattctgtgtagcccatccaagaattgactaaacccccagattaggaactactttaggaagtggatagagtggtaccccaaaaggtattggctgccaaataaatgtagcaggatgcagagttatatacatgttgttggcatcattgtggaggcatctgattcagggcacagccctgacatcggactatgcaaattgattgggacaccattgttatcgtaagagagaggaatttttccattcacgaagcctcaagtgtactgttcttctataggctgaggcatagggagctgccaaggtggaagtcaaaaccttgaggggcaggcctgagagcccagttgatcccagggcttgtatctatgtgaatgaagccgccccacccctggcacccagttgggattttctccagcagcagctgcaaaggctggaagccccttggagaagcagcagagaaataaatgagaaggggatttgatccagggctggggagtggcggcggatggcggatgtggttcaaaatgacaaggggtggtgggggaagaggtcccagttgaactgaaaatgaaagcaagacaggaacgcactgtcacattgagaggatagcattttagctggagaatgtacaggagaaggtgtagacatagttttgtctgtgtcagacaccttgatagcaaacactataggtagaggcttctggaggcaggattgctcttagtctaaggtcttatggtaacatttgcaggggatacgggttagcattacaaaatggggatgcttcaggaagggcgtgggcgagtgcttcttgctattacttcttgtaaccaaagctagtctaggcttttgggtatgttcaacactgcatggcctttggagcacttttatgggaagaggtaagaaaatgttcctgtgggcacatttagcacacagactaaatgtgagcttcaaggaagggagggtgggtgggatagacagagagagagaggttgtttaggaggaagtttgacaaggggaaagctattaccagcacaaatggagttttgcttgagtcatcgacttcttctcaggtttaattcaagtgcgcaaccaatactgtttactttttcttttttttcttttttttttttgagatggagtctcgctctgtcacccagactggagtatagtggcgcgatctcggctcactgcaacctccgcctcctgggttcaggcaattccgtctcagcctcccaagtagctgggactacaggcgcgtgccaccatgcctggctgatttttttggtatttttagtagagatggggtttcacc[138 bp omitted]tgccttgttctatgaaaacttcatatatggcattgtgaatttacaaaaagataaattagtgagtgatgattcatactattaaaagtgttcagtagcagagctcctttggacagctaccctaatgtttgcctttcagtgttttagagattgtggtcatctaggaaagattgtaagaggcagaaaatcttaattctgaaggttaggaaaatattgaccatggatttgtactttgctcatttgaagagctagggacagagcagtgaataagacaacgacactacaatcacagaactttcatttaagagggtagagagacagaaaaggaaacatcaggcactgcaccttggcacctctgaaatgggctgggatggcgaaggaagcgtaggaaatagaatagctctgggtttcagaaggtgcactgaataggaagaagtggtcacctgtacttgggtagataaggcagcctcttggggtcttgaggtggggggagtagacataaccaggcagagaggtcaggatcatcaaatatgagataacatgacccattaggaggtctacccaccctgattggaggacatggggctggaggctgaagatggagaccagatcacaagggatctaataagccttgctgaacagtttgagctttattctacagactctggtgagccactgaagggattgaaacaaagaaatactgtgatccaacatatttctcatcaaaagttggaccattttggatcaaattagccataggaaaggtgttgggaacaaattaagtacagattggcagctgatcttttccaaatgaaatattctggttaatctctgtcacacaaggacaatgcaaacattttctctctcttaaagaaaggcttttcacataagcagagtcctcactttattttcctcaatagttttgtatgcaactctaatgagtagttttccataattcagtgtattactcctggaaaacatagacaataggacaaatttttagcctatgctgtcattttatggattaatttccattaacgttgaccttctggctttcagtggataaatgtgagtaaaacatctgttcatgtcattcccttgcttaaaaaccacttctggctccccatcacctacactaggaaacagtctaaactcattgacttggcatatgtggtcctccataaacgttccttcccagctcatcttggccattcctccctgttctgtacaccccagaatcaatgaacacatggctttcttcttctttgctaagacttatgctctcttccttgcctgccatggggatttttatttcatccttcgagtctcagctcaaaagctatttcctctctgaactgccttcaccagtgatatgaatcactcccttccctgtgtctgcatggcactctctgtatcccctaccctagcccttactccattgcatcatagctcttgatttagggatctctctctccctctagcccatgagtttgttaagggcagggcccacatcttgcctgcttttgccttcccagctttgtagctccactgcctgacacatggttaatgctcagtgaatctatagaactaagttctatgttttctatttctgtttataagattccagaagagccctcggggaatgacagagcagcaagcctcacttttgtagcaggctggtctgtgaaatatatggctatggtgtaggaacctcaagcattgaaaactaaccattggaatgaagagcaacatgatttctgtactgagaactcatctcttactaaatattggagattttgttgttattgttgttgttgttttgtttcgttttgtttttggatgtataaggaagtgaggttgggtgcagtggctcatgctggtaatcccagcactttgggagtcaggcaggagggttgcttgaggccaggagtttgagaccagtctgggcaacatagggagacttcatctctacaaaaataaaaaagaaatagccaggtatggtggtggatgactgtggtcccagctactcaggagactgaggtgggaggatcccttaagcccaggaggttcggggctgcagtgagccatatactcaaaaaaaaaaaaaaaaaaaaaaaaaaaaaaaaaaaaaaacaggaagtgaagctgagtaattttatgttttacttttcttgacagcctttgagatataatcctcattctatacagcttaaccatttgaagtgtgtatatatatatatatatatattgtttttttgaaacagagtcttgctttgttgcccaggctggagtgcaatggtgccatcttggctcactgcaacctccgcctcccaagttcaagtgattctcctgcctcagcctcccgagtagctgggattacaggcgcccgccaccacatctggctaactttttgtatttttagtagaggtggggtttcaccatgatggccaggcaggtctcgaactcctgacctcaggtgatccgcccgcatcagcctcccaaagtgctgtgattagaggtgttagccaccacacccagctgaagtgtatattttcatttttagtatattcaaagatatgtgaagtcatcgccacaattttagaacattttcatcacttcaaggttatttgtttaagacagtcaaaaaacctttcatagaggtcaactcttaagacttcttttaaatggtatctctggtgatagggggtttgtcatagggaagggaattggcttaaagaagaatataaagattatagataggggcaggcttttttgtttcagaggaggatgtgtaataaaaaaaaaaaaagctgaacacccaagggatggtttaacggatgctggtctgacttaacaccctttctaaggatagagagaggctaagctattggagctttcatacggtgagaccctataaagttatagaacatggacaggaaagtgagacatgggtttctagagagacaagaattgggaaaataattacaacttattaataggagagtatgctgtaagcttaattgaacttgactgaagctacacgagagcaactgaggaccaggatgtgttagggccaatagaacggtaaaattcagggcatgatcaggaagggctttttggcaggcatctgtagacacctgcctcacctcac[174 bp omitted]ggtggtgggcgcctgtagccccagctactcgggaggctgaggcaggagaatggcg[150 bp omitted]cctcaccatatcctgaaatgttataccacaaggtggagcatctcctgacattttaaagataaagaggtaaactgaagtcaaaggagctatcactttatttactttacatagcttttatttatttatttgtttgtttgtttgtttgttgttattaatttttgagatggagattcgctcttgttgccctggctggagtgcaatgtcatggtctccgctcactgcaacctccgcctcccgggtttaagcgattctcccgcttcagccttctgagtagctgggattacaggcgcccatcaccacatctggctaatttttatatttttggtagagacagggtttcacca[134 bp omitted]tgtataaacttaaaatattggtgggcccaaaaaaggtagagataatttcaattaatggatagattcaatgtgatggatggtggaaaactaaaatatttgtagaaaggtgtatttttgcccctatcaaggttgattttcaaactagagtctgtcagttttctttactccattatcaagagcaagttaatgagatgggtagaccgattgccagatccagtgtggaaaatgatgtgtggctgctttatagattactgagcttctctaatggagtaagtttatgctactgtgttcaaatgatacaaacaggacctctaggaggttatgttttattgaatgtaagtgatttagatggctaaatctacatacctatagaatgcctgtgcactttacagttttttctgcttaagaatgcaagttatgttagagttttgtttataaaactcaggaaaaagtcagagatgtctttttgttgttgttgttgttacaagtttaaggtgagcactaagatctgaggcaggttataaaatagttgataggcatagaatgagcacagtctaatttctccttgcaggaatgaattatttgcaataatttgtgtatgtctttgtgaactcgttaaattctttgatttgttagaaagtcattatgtatctccaaggcacatttctttttctttctgtcaataatggtgtactaaagaatagaaaaaaaattctaattttaaaaaggctctttgccattctagtctctcaattattcaagcccttcttttcatttcttaaacctcttttgtgttacttttgagtcatttaaatgcttattagcacagagtgagcacaaaaagccaggaggaattgaattcaaatcagctttcctacctgtcaacaagtttgtcgagtaaagttttggctaaattgagttttggggtagaaagttcatgaaaattctatttatccatttgtaggtaatcaaggttatttgcataatatttgaactggctgtaatgaaaaatgtttgttaatagagtgtgcactaatcatatagtgcatagtcttgtttgtttcttattgtttttaaagtaaattctttgtaagtttttaaaagtagctcttgagtttttgtaaatagttaaatagacttggaaaggggaaataattcggcagttaaaacaatttcttccctatgctaaaactctaagggaaaaaatgggttttatttttccttaatgtttctatgttagatttaaaggccttcgaaatcatattgtgctgattcttagaacattaagttgttgttcctaaattaaagctgggaagtgaaaatttaattctgaaagcatcagcaacaacttgtccttctctccttgtgtgctgccattttagcttggaaggcatacgtgtaagagcagtctctttgtactatttagctggttatccctacacaaaaacttctggctttgtagttctcagggctctctgctaggttgtgtggaggatattgaggtgaattagacatggtcccttgacaatagcgtactgttgtttttttttgtaatttgattcttaaccacttgaaattgaatctgccaactcctttcccccaagtaaaagacctaaggtgctaatccctactcactgatgacaaatgctaaattggaagcaacagcttaggaatgcaaagatccttatccaattacattacaagctctctaagccagtcatgttcagcatcatcagggcgataggaaggcaagatctcactttggtaagaatgatagcgtagtttgagtaagttttagaaaattctaaaatgcaaagttcattcaaggaaataaaatgtggtaggagctgagaaaatgatttgcttttgttaagttcaacgcataaaggtttatgtggatcatggttaagagcactggcttgggagtccatcagataaagatttgaatcccagctccacaaatatgtgacactggacctgcctaagcctcaatttcctcatctgtaaaatgggcataataaaataacctctcacaggattttggggagaattagatgagatcatagatataaaacgcttaaccgagtatacagcaatgcttaatgtaagtggtaacagaaagtacaaggcactgtttgctgaccgaaccggtgtttttgatcctgcctaggagactaagtaaaccacccaaaaagcagttaagtatccagggaatgttatatatgagtaaatgccacaatagatgggaaagacaataagggctgttggggagcgaggagggctatgctatcataagaatcaggtgagctaagtgtgggttggtaataaacatgacccactggtctcatggaaagtatgacttttcccttagccgtttactttaagaaaggtcagtgtcctgaatgcagtttgtatttagattcttatgccaagattttccccagaaaataatctttatgaaaagatgttcatgtctattttggcaagttgggttctgctagttaaaaagatgcccctcccgccccaccacatcaccattagattgtagttatgcaaagctccttcagtaattggagttcctattggggaagagacaaagagatgagctgctgaaagatggtcacatttggaacaaacaggccatggtcataacaaagtcaaatactctttatttgaaccttatgaagaaatttcttacaggctggacacagtggctcatgccagcactttgggaggcttgatgggtggatcacttgacctcaggagtttgagaccagcctgggcaacacggcaaaaccccgtctctataaaaaatacaaaaattagcctgatgtggtggcacacatgtgtagtcccagctacttgggaggctgaggtgggaggattgcctgagcccagggaggttgaggctgcagtgagctgtgatcaaactactacactccatcctgggcgacagagtaagaccttgtctcaaaaaaaaaaaaatccttacagttatggttccattattgacatgctgtatagggttcctctctagaagtctctaatctacagtggtggcatctctcacttctgtgaatcataatgcaacttttgcttctcctcatattcacacaccactcttgacagttacctagtctctgatcttacagggtttatgaataaaactagaaggcaagatgaaatgatctgagaccacataaatcgatatgatgaaattcttctgattgatctaatggggaatagagggactcacacattttagtgtgcaaacacacttgtacagttccttttttggaagaagatatggctatcaaagggcatgatagatgcacagaaattacaatagtctgtgatcagctctcacatcttgggtttatctaccttccccacgagactgtgaacttctcaagggcaaggtctgtttttttattcacctctgcattaccaggggctagcacagggccagaacctcagtaggaactcaataaatgcatctttatgctgaactcactttgttttctgtgctgccggaaattgcatgcccccagtggccattttgagtgcaaagtgttattttaagatgctctctagagaaagcactctaggctctgcttacaaatgtctgagaggaaaggagagccgaatgactaggggatctggagaaattcctaagtgaaggtcgtggagaaatgatgggaaggagagactcacctctttttgagtgtgctacttctatcccaagactgttgttatttttcataagaaaatgctcagatgtcattgaggctgtagtctgactgcaatactgcaaaaaagcacttttgggctaatcattctctttctgaaaccagtagttgccatgttcctccttgtgctgaaactcagtttggaggatggggtggtggtagtggtggcgtggtggtgcagggatgtttttgaattggctctgtgccctactgctcagctttctgcctgctttctggtatccctcccagtgtgataaaggagagattctatgatgccagtgttcacttcagacttgcagaagagacattcttagaattcttaaggagaactagtttctaaagtaaaagatttaccggtaaactaatgacctttggtatggtatttaagcagaagtaacccaggctcattttgcattgcttacagataaatattatgtgattattcttgtgtcttacacatttctaatgataacataaatatgcctgctagtcaaatgtgcttttggatacatgagtggttggatggttgaatatatacattcatgtacatttttatgtattttagtattacaagcatggttttatatttatacacatacagttacgatgataaaagatcagtcatcctgtactgcgaatgtacaggaaccaccacaaaattgtaaagtctaagtggtgatgctattagtgaccctcagtgaggatccattgtttcctctctttggaccaagaagtggactgcaactgaatctattctgacgagtttccttttttgctatctgtcctttccacttatattagaaataaaattatctcaatttatggagctgtgcatttcttcccatttgtagagtttgcacatagaaagctcattgagatttggtccttagtggcctgagtaagcaacggaaaagtgtactgcatcccacaccatggtaccaaaattggcatttttattttactagagatagaaaaatgcaatttattctcctttatgggatgatatgaagctttctttttcaataaatgttttcaatgaagaagatatttgatttgaagaaaaatatgaagtaaatgataatacagatggtgtggcaaatatgaggattatatgtgaataagttcgggaaactaatagaaacaaggattaggagttgggagacctgggtttgaatcctggttcagctcctaatgtagacagatgaacttaggcctctgagccagtttcctgatggataaagttgaaatgatggtattttccttgtctacttgacaaagcgtttggtaacaaacagaatgcatatgaaagtgttttcttaagactgcaaagtgaccttgaaatgaattaacaaaaaatactaatattattagcaagttattcaagaaaacttaggagtcagtgaatgaaaacttttaagaacaaatcattttgttttgttttgttttccccatggtgaaaactgagttggttccaaatttaggttgacggttttcctgtcactacttacgggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctcacttatatgtgaaatctaaaacaatcaaactcatagaagcagggtagaatggtggttaccaggggctgggggcaaagtgggggagatggtagtcaatggtgggatacaaagtctcagttaaacaggaagaataagtttggtttttttgagatcaatagtatagcatgctgaatatgcctaataattgagtactgtacatcttatcactaagaataaatttctcatgttctcatcacaagaaatgttaaatatttgaggtgatagatataactagcttaatttcatcattctacattgtattaaaaatcataacaccactttgtaccccataaattaaaaaaataagtgattcattttgacatattctttccatattaatttggagctacattagaaagctgaaggagggccaggcatggtggctcatgcctgtaattccagtactttgggaggtcaaggcggggggatcacctgagctcaggagttcgagaccagcctggccaacatggtgaaaccctgtctctactaaaaatacaaagattagctgggtgtggtggcaggcacctgtaatcccacctactcgggaggctgaggcaggagaatcgcttgaacccaggaggtggaggttgcagtgagctgagatcacgccattgcactccagcctgggcaacaagagcaaaactccatctcaaaaaaaaaaaaaaaaaaaaaaaaaggaaaagaaaagaaaaaagaaagctgaaggaggattttcttttttttctttttcaaatatacttgaagtaggtacttgtaaaattattgtacagagaagttgacagattcaacaggttaaaacattgaaatttgaggactgtttttgcaatctgtactaggaaaatagttggcaccaaaagcaagacttagattatttttagtgcctcaagcttgctttcttagataggacttattcattcaacttctctgagaaattgatctcagactgtgagcgttagagctggaagatgcagtcagtttccttttgagtccatggaaacacggtagatatggccgaaaggggtcagatttttctgtcagaaaatctgaatttctcaaataggattttttccttttatttcaactcattttgcagtagtatttgcagacatgagagggatgatcaacttgctttgatctttgtagacatgggtctacaaatccaaatttaagacttgaaataaagcataaaggttaggatcttttagatttgttgaacactgagctcattggtcagagtagtttactttaatctttctaaataatcttctacaggaaactctgagatgcccttccgatatggaaattgggtatagctgtgacctgttgtgaaccatgtataaaaactattctcaacttttctatggatgtagtgatactagagactacctcaaatactatgtacaaaaatacaagtataatcccgatgctattataatattaagtcttaatataaattatatttggggtttttatacagtttttattataaaattttaaggaaataatttcatatgaaacatcatcattaaaaattactactgtctgcccaccttggtttagaatagagtgttgagacatggctctggttgaatctgaatatctcaaagttcatcagcaattaatgactggatgtctaccgtgtgccaggtattctaagtgctgggattaaagaagtaaacaaataaaagaaaatccctgccctcaaatagtcagagaggtgaaatagatggtatatcagattgtggtaagttcaatgaaggaaaaaaaatgataggaaggtaaatagtgggatcccattcccagttcagtaccatgcacatgagaatcttggtatatttctttctttttctttccgccccccgctcccccgcagttgcaggggtcaagggctggtggtgtgcatgcatgacagctgtgggtgcatgtacagtagtgatggccagtggtggaagtcagggtcacctcatatggctgtgggggttgaggcttatggcatgcacacctgtgacaatgaaaactagtgatgatagacattgaagtcagttgcatgtgtacacacagctgcagggtcagccatgggtgtgcagaagtgggtgccgtctttgtgtatttctgaggggaaaaagaaaagcagagcctttgcagtcacagacctgggtttgaattccagttctgaaggcaggcaagttacttaacctcagttaggtccagagtctctgcatctgtaaaatggggataatgattcaatctgtttcatattgctatgagtgttacatgaaaaaatgtacagaaagcgcttagcacagtgcctggcatatagaaagggctcagtaaatgtgaactgttaccactactcttattatgttacatcctggctttcttagcatcactgaccctgcttcttgttactttagcttcagtctgggtcctactgtcaatggccagctcgcctagaagtccagcagggatccactgactttgtcaccttgaacctaaccctttcataacctgcccaagggatcaagcatctctagtatctatgcctgccctggatatgctggaacttagtatgcccatgggacagtgtccctggtacagagtaggaacatgaatgttgatactttctcctccaacgttgcccagagagtagtacagatgcagtaaataccaacaggcacacttccaagtatgccactttttgttttacttaaaattcaataatttttagaaggcacacagattaagtagaataacacagttctatttctccagaactttttttttttttttggagagacaggatcttgctctgttgcccagatataagtggcacaatcacggatcactacaacctcaacctcccaggctcaagtgatcctcctgcctcagcctcccgagtggctgggactacaggcatgggctatcacacccagctaatttttgtactttttgttgagatggggttttctcatgttgcccaggctgatctctaattcctgggctcaagtcatccaccttcctcagcctcccaaagtactgggattacaggcatgagccaccatgcccagccagaactctttatctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagacacagttaacccataaaggaagatcccagtactagtaattgccaaatggttttagaaagcctgtcggcatagtaccagagttttaaaaagtggatatatatgtacttttcctatatttcaaattcaagattcctattttctttcagtgtattaaaacctatagcacagattggcacgtggtaaactacaagtatgaggacttctctggggactttcgaatgttgccatggtaagtttagcattccagggaaacatgcaacaggag[145 bp omitted]cctgtctctactaaaaatacaaaaaattagccgggcgtggtggcaggcgcctgtagtctcagctacttgggagggtgaggcaggacaatgttgtaaacccgggaggcggaggttgcagtgagcggagatcatgccatcacactccagcttgggcgacagatagagactccatctcaaaacaaacaaacaccacttgtgaaacctttcagttataatttgtaataaagcaaatcttcaaggaacctgcatgtttggttaaatgcagtgttttggttaattgaataggttttaactttcctctttgaaattccaaaatgtatgagagctcactttttggctttagtgaacctgtattgatcataaactaaaatatagctgatgatggataatgtagtgagcattttccagtagtgtcagtgaaaaagcttgatgataattagttcagtttgatgaacctagccatcccttggaaaaagtgcatctctttcagttgaattgaaggaatggcatgagcacactggcccaggagccagactgttggggctcaaatcttatttctaccacttactagctggatgaccatggctcagtcacttaacctgtttgagctctccattttctcatctctagcactaattcctcacaggatgtcatatgggaaatgtttttggaacaaatagcagaggaataagacatttgtttagccttttgtagttttcagagcactttccaaaagaggagaaaactgagtcctatatgacagcctggtccttgggaaaaaaaaagaaaaagaaaaagaaaacagagtcctaaaatgaccagtccaag[135 bp omitted]gcaacctctgcctcccgggttcaggtgattcttctgcctcagcctcctgagtagctgggcttacaggcacccgccatcacccccagttaattttttttttttttttaatttttggtagagacggggtttcacccttttggccaggctggtcttgaactcctgacctcaggtgatccacccgcctctgcctcccaaagtgttgggattacaggtttgagccaccacgcctggcctgtgttgctttttgacccggggaaggagaagttctgccaccactaacagctctggcacaggttccttagcaacttctgccctccctaagtttctgggcttagttatgtcttcgctgctggccacatatgtggaagtccttacagaaacacaaacttacagtaagtttactcagaggggataatctgaatttggaaaggagaataggatgtcttggcattttctcgtttgtgaaagaaagaaatctgctcatcttgcttttactgttgttgtcattattgttgtgtttttgtgttgtttttctttttttttttggtctttttagtgtctaagacagttctcttatatttgcagtaaatctttgagaccagaaaagattcctaatcatgtatttgagatagatgaagactgtgagaaagatgaggtaagaatgggggcaacagttggggtaactgtgctagtttcctcacggtcactttgctgaaaaagatttcaaagggaatttcttgagaaaatatgaaggaaataattattctggaatgatctgtggccagctttcaaaccgggtgcttttcaattttttttttaattactgtatttccaagtagggtttaggaaaaaaaatcaagtgagaggggctatgatttgtacataaacatgttcccccacctgtgggacatgcttgtggagttgcttttcttgagttgggcatgtggtgtggtgattcatctggactctcctgcctgatagattcctcttgggacagatggcccggatgtctgtgacatttcgaggtgcagttcgactgtttacataatgcagaagatttcccagaagagagcccataccattcagtaaatactgagtgcctactgtgtgcatagcacagagcctttcattctacagtcaactattttaaatcctcacggggaagaggggactttatgttttaattaggaaatgggcagggcctcattctgtgcccctaaatgtttcgctaattagatggcaggctggctgttgttttactgataatttttgttctatttcaggactcatcttctttatgttctcagaagggtggtgtgataaaacaaggctggttgcataaagcaaatgtaaatagtaccatcacagtaaccatgaaggtaggaagtagttattatattattccatcattttaatgatattggcataagtagtctatctggaaacaatatttattttacaaagagccctagcaaaaaaaaaaaaaaaaaaaaaggagaggattctcacagacgtatggaatttaaaaaatctaaaacatcaggataaatttagaagtgcaactttttaaagacatataatgtaatgattatctggtgaatcaggatgtttaaaaaggaggctgtcagttgaaggaggaaaatagctttgaaaaatgggcatcaaagtttcatatgtagaaatgaccttaatgagtggaaggacaagtaatccatttctttagcaaatattaattaggtacttattacatattagtcactgtggggaaatatgtagatatctaagatgtggtccttggtctcagcctctagactagacaagaaatatactattttaactagtatacaaagcagtcctttagtgcagtgagaacagtctaactagaaagttttgtagtttgacaggatagtgagtttgcataaggggtttaagtgagctaaaagttgaaacgttgaaaaggataaaattgggctgggtgcagtagctcacacctgtagtccctccttctttgggaggccgaggtgggtggattgcttgagggcaggagttcgagaccagcctgtgcaacatgatgaaaccccatctctacaaaaactacaaaaattagcctggcgtgatagcacacacctgtagtcccagctactcaggagactgaggtgggagaatcccttgatcccaggagatggaggttgcagtgagccaagatggcactactgcattccagcctgggcaacagagggagagtgtatctcaaaaataaatagataattttttttttttttacaaaaaaggataaaattgtgcagagccttgaacaccttggacatgaggttcacttatttgggaggctgtaaagagccattaaaatccaaagggaaaacaagctacatgaggattctgagcagaaaaacaaattatgctctgataccaaatataactgttctttcagatattcaatataaaatcatgtggttttctgaggatgattcacacttgcattaagtattgaaggtcattctatctttcacacaggctgcaagtagaaaccgtgggtatctaccaagggaagactcaaattttatcttaatttaatattttgcctgctgccttccctttggtgatcatgtcctgttctcactttcattttcaagccctgaaaataatgaatccaagttgtaggatacttcctgtatatcgcttgcacctaagcatgggcatcagcaagtggtgataataagagaaaccatttattaaggacttaatacgtaccagacaccatactgggtgttttatattctgtatcttgtttaattctcatggctgccctatgcaataggtactgctaactattcttagtttatagatttggaaagtgaagctcagagaaattcaataattaacccaaggtcccacagctccaagttttcagaggtaggatttgaacctaggcaggctgatgtcagagcctatgctcttaaccagtatactatcagtgctcactagctgaatgagactcaagggtttattaacaatatatttcgtgccagagttatcaggttcagaaatgtacgtgaaggttacatttctgtgtggattatcagaaaatggttgtatcgtttttgactgcattccctttcccgcagattctcaaaatattcaaatagggccaggcaggaggctcatacctgtaatcccagcactttgggaggccaaggcaggaggatcgcttgagcccaggagttcgaggctgcagtgagctatgatcacaccactgcactccagcctgggcaacagaattagatgctgtctctaaattaaataaataaatgcatgaaggaatgaatggttttaaccacatttaagccttagcctcacattaagtaaatgtgcaaaaatctggattcataaaataagatgttaggaaattaatatctttacagaataattcgccacagattcctttagtttaatacctttcaactttaatttgccttacaaacaacttctaattttgtaggagtccatatattataagccaaaaagcacatgctttacattttctctcataatttgtgaaatacacattgattgattgatgtgataggaggaattgatggcctctcaaagatgtccatgtcttaatccctggaaccagtcaatggtcccctacatggcaaagaggaattaaaattactaatcggcaggagggacggtatccacaattatgcgggtgggcccagtgcaatttcaagaaccccataagtggaagagggaggcagaaaaggacagtcagggaaagagatgtaaggatagtcagggaaagagatgtgagaacagaaggagggccagagagagatgctgtcttgctggctttgagggtacagaaaagactcacaggccgagaaatgcaggcagcttctagaagccggaaaaggtaagaaaatggattctcccatgcagcatccagaaaggaacatagccctgctgacaccttgaatttagcccagtgagacccatgtcagacttctaacctgcgaaactataagataataaatttgtgctattttaagccatcaaatttgtgctaatttattacaacagcaataggaaactaatacaattagttaggcaaaggttgattgttcagcttgtgtgtttcttatccctgagcttggaaactctagcactaacagtgaccaggcgggagccataaattcatagagtgtgtgatgggtccgaggcaacctggtgaccacatagcccacagctgaaggggacagctgccacttgtctccagctaattgttgttttgctgcagctgagctaggctctttgctttgcctctttttatcctcagctgctcatattctgtgtgtgtgtgtgtgtgtgtgtgatcattaacatataaaactttttttttttttgagatggctcctagctctgttgcaccaggatggagtgcagaggtgcaatctcagctcactgcaacctccacctcccgggtttaagccattctcctgcctcagcctcctgtgtagctgggattacaggtgcacgccaccatgcctggctaatttttgtatttttattagagacggggtctcaccatgtggccaggctcgtctcgaactcctgatctcaagtgatccacctacctcagcctcccaaagtgctgggattacaggtgtgagccactgtgctcggcctatttctttctttttaaaatctctaccaaacatcaggcaaaggaaggaaaagaggaataaaccaagttaattggtcatatgaagctacacaacttttatgtttatttttatcatttatttatttgtttttgagacagtctcactgtgtcgcccaggctggagtgcagtggcgtgatcacggctcactgcagtctcaaactcccaggctcaagcagtcctcccacttcagcctcccaagtagctgggaccacaggcacatagcaccgtgcccagctaattttgtttgtttgtttgtttgtttttgatagagatggggtctccctatgttgtgcaggctggtctcaaactcttggactcaagtgatcctcccaccttgtcctcccaaaattctgagattacaggcatcagccaccatgcctggctactacacagcttaaaaaaagttaataggaaatactttgaaatgcaaaggccatattgaggtttgggagctgtttctggttatgagtttcctttatccccactcttttccattataaattatgaatctccattttgaatttcaaactcttctgatttcatctcctgagccatagcagtagtgttgtatttcagaatttgtcacagctagaatgggaatcagaggaaggttcagctagaaccttctgaggcattttgccaagattactttttcctctaataattgtattttgggccaggcgtggtagttcatgcctataatcccagcagtttgggaagccaatatgggaggatcacttgaacccaggagtttaagaccagcctaggcaacatagcgagaccctgtctctacaaaaatgaacaaaattagccatgtgaattggtgctcccctgtagtcccaggtacttgggacattgaagtaggaggatcacttcagcctgggaggtcgaggctgtagtgaggcgagattgagccactgcactccagcctgggtgacagagtgacaccttatctcaaaaaaaaaaagtgttttaactgttatttagttcaacattattgaaattagttggaactgcagtgttgacacatcattttttcatgttctctttctgtatcaatacagggcaagtgagtgtatggggcagaggattgaaaagggggagcagttttatagtttccaggctagaacttgaagtgaaggccaaagcacaagtccaggcctatgaacaaaggcacactgggagagtctggtttgtacctttcagtgctctgttacagggtgggggatcatataagttcttcctgcatcacgtctggattgtttcaggcataggaggctaaagctaaagatgaggtgagcagctgacccagctcttggataattggaaaaggcagaggcagaagaactgagacaaagggttgacagagtttgagaggaaagtttctatgtattttttttctactatggtaatgtttgaagtgaagaatactaatgaagctcataagcaaatgggaagatgactcaggtgtgctattatctgagtcatttccccaatcctggaggcaggtttatccttagagcatctggagttccctgcccgctaggaactccagcccacactggtaagaagcattggtagatttagcaaccagcacctcagggccagagcttgcagagttgagagcaaagaatcttttctttttggaaaatccaagcttcgatagcccctgcaaactcatggcaaactaactaggaagcaagagcagatctggttattaaccatgactcagtggcaaataacagcctccataagccaagcttcttccctgtgttttagctgagcttatttgatgccctgtggcttgacactggcctgcagttccctctggaattgctagggaataaaagcaaggcatcttggtgccttttagagagaggtgtacgtttaagcgtctttattcattaagaaatttctaaattttaaaaattatgtgctgggcatagtggctcatgcctgtaatcttagcactttgggaggccaaggcaggaagatggcttgagtttgggagttcgaaactagcctgggcaacatagcgagccctgtctcttcaaaaaataaaaaaattagctgggcatggtgacgcatgcctgtatttgcagctacttgagaagctgaggtgggaggatcgcttgagcctgggaggtcaaagctacagtgagctgtgattgcatgactgtactccagtctgactgacagagcaatactcgatctcttaaaaaaaaaattacagtcagttctttggaaagtttgaaattatgcgcaactttaaactgatcttagaaataggtctgagttgttttgctggacattttgactgttagaaataaaggaatctgcccaggcgttcatgaccagcctgagcaacatgacgaaacctcgcctctacaaaaaatacaaaggtagttagctaggcgtggtggtgcactcctatagtcccagctactctggaggcttaagtgggaggatcacctgagtttaagaggtggaggttgcagtgagccaagattgtgccactgcactccagcctgggtgacagagcgacactctgtctcaaaaaaaaaaaaaaagggagggagggaggactctaatagcaaggaagggaggaatcacatcgtgagagaaagtgcaaaaataaaacgaaggaaagagtattagaagagactcagcaaagtgcagttgataaaagggaattagaagattccaactttataagatcttttgagaaagcaaccacatggcctttaatgcaatctaaataatatagccaaactaatttgtatatgggttgctgtagacagtttaaccttcctagctagcttgccagcaagttttgcaagaacattcaagtcgacagttcttgcaatgacttgcagtgcattcaagtcgatgggctgtagggaaaagaggggctagtagaggaactaggctgagttcttcgtattggaagattataagaccacatatttataggataaaaatttatattttccccaatatatagctttccccctgctctggtcagttgttaagatataatctgtaccaccttctgaaatgggcatattttcccagaagtgcttgctgagtataacctcattgttggctgagaaacttgccctgaggagcctggactacaggaaagctgcgaataatgtgcatcactccacgagtcacagtgctctgtgcccaagcacttcctctcactgaagaggatgcatcatgcagttcttgcagaagctctgttgtactgggtgtggtggcatgtgcctgtaatcccagcaacttaagaggctgagtcaggaggatcgcttgagcccaggagtttgaagctgcagtgagctatgattgtgccactgcactccagcctgagcacaaagcgagacctcatccccttttttttttcaaaaagaaaaccccaaaaaacaaaaaaccaacgctctgttggttgtttgggtgcagtgaacatttagcacttgtaatttgctttgttcttggtattcaagttaaaacaggacaagccttatcatagtgattaatttcgtcaatttgtggtttctagttaatgaggaggtaccttgctgccactcttcaattcctggaaaagtattagagagaagttttaagatgtcatagagaatacatgatcctttagacagaaaccacaatcctaacagacccctattcatttacattctctctttcccaagtagctgctagagacatctgctttattcaacttcttttcatatcaatgaaggaatttaatgtgggtttagatagctgtgatattggacatagccttcccctggtatttagaactatttctcctaagagatataatgatatatggaggaatttaatcttcagggtggtttttcattttttaaaaaattgctgcagattcttggccaactcctgggacacccacctttatgcatctttttggctcaatttggtcacattcctctagctctctcctccccattctcagcaattaaacgctgaagtgccttgatatgatatcggggttgcaagttcaactggttgatgtatgactcacttctagtgccctttaaaatttttttggcacaaaaagagccatttgttatatatccagagtccaaaagtccttaaatccttaactcttccaggagggatttttcctcctctgcagtgggagaacatcaaatcaaatgaggatttgacctaagaaagcacatacaatattaaaataattgctaggaggtcaaggtcactatgtgtgttagaacaaaaggaagagaaaatattttatttttgatatcttagtccaattgtattctcaaatctaccagactatctcttacagctaacaaatggattgcattcatttattatgcataagattttttcattaatttgttttttatgttttgttttctctcattcatattacttctcaaaaactatttattaggtgcttcatatgtgtcagacactattgggtatcaacaaattcatgaccaaatagataatttcttaatttaattttttcagagacaaggtcttactatattgccctggctggagtgcagtggcacaatcatagctcattgcagcctccaacacctgggctgaagcgatcctcttgcctcaggctcccaagtacctgagactacaggtgcatcccaccacgcctggctaccaaatagatattgaatgccttgttaatacaaggtattagcattgtggagggtagagagaagtgtcagatgtagagcttaaaacctttttgggaaggtgggctgggcacagtggctcacacttgtaatcccagcactttgggaggctgaggtgggctgataacttgaagtcaaaagttcaagaccagcctggccaacatagtgaaaccctgtctctactaaaaatacaaaaattagccaggcgtcgtggtgtgcacctgtaatatcagctactcgggaggctgaggcaccagaatctctcgaacccgagaggcagaggttgcagtgagctgagatcgcaccactgcactccagcctgggcaacagagtgagactctgtctcaaaaaaacaaaacaaaacaaaaaaccacctttttggggaggtgagacacacaataaaaataattgtttaaagatggtacagtgaccaagtgctacatgaatctagatcattgtggcctggggtcagagaaggcttcttgaagaaggcggggcctcgaaggaagtgaatcagaaaggagaaagtgagtgtgccaggcaatatgtataaggcagaatggttaggtgaagctcagtagtcatgggagatgaagttgatttggttctttggtatcaccttgtgcctccatttctcttctgtaatatggagggcataacagtaatgaccacataaattgttactaggattcaatgaaataatacaaggaaagcacttaaccagagaccataatgcacaaagcaccccacagatgttagcaattgttgttattttatattattaggattgtgggagggccttgaatgcagtatctggcatgtgtgccttatgtgagtaattgagagtcattgattatttgagcagtgacatgctgtgctgaaatacatctgataaaataatttgtctgtaatgagaagggtggattgtagacccctcctactagacttggctttaaatcaaatagttgaactcttcagtgcccagatacggtagaattatttaagaaaagctatttgatttttactcagtttctcagtgggtaggagagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttgaaaagaaaaaaaaaaaacaaaataaacttgataggactgtaaatgacatgatggagagaggtgagtgatatatcaggttgccaacgtagtggtaggggttctttagcaggatgaagttcctggcattctggtgtcattactgcaactcacttttctaagtcctgtggtttttttccccattgtttctttcatttttgtgcagaacagttctaagacccagtatgtctctgtctctcctgctttctccttttccttgctggctcttccattgtgttctgtctgagacattaggcaagttcccctacatcatttctacattgctcttggcctacctactctgcctctaaacctttgatgtatcctttctaagggcttctggttcatgcaatttagcagtaaataattacccctctaggtaacacacaataggtaaacgctcttgggatttgctgtataaaatgataaaaggttttcctactttcttttctttcttttttttttttttgacagaggatctcgctctgtcttccaggctggagtgcagtggtacaatctctgctcactgcaacctctgcctcctgggttcaagcacttctccagcctcagcctctcaagtagctgggattacaggtgtgcaccaccacgcccagctaatttttgtatttttagcagagatggggtttcaccatgttggccaggctggtctcgaactcctgacctcaggtgatccacccgcctcggcatcccaaagtactgggattacagatgtgagccgccacccccagccattttcctactttgaggatactaagtgctccaactttccttcctatgtttaatctttgatgcagctgaatgacaaaaggcctttgttcctgctccagaaggggttcaaaaaggttgtcatctggccaggcacggtagctcacacctgtaatcccaacactttgggagggtgaggtgggtagatcacttgaggccagaagttcaagaccagcctggccaacatggtgaaaccccatctctactaaaaataaaaataaaaaaaaattagccaggcgtggtggcatgcacctgtaatcccagctactcgggaggctgaggcaggagaattgcttgaatccgggaggcagaggttgcagtaagccgagatcacaccactgcactacagcctgggcaacagagcgtggctctgtctccggaaaaaaaaaaaaaaaaaagtgtgtcattccaacagcttggggccttaagcacacttggcaggacctgatcctatagaatcaaatcctttggcttgctctctgttttattgttgtgggtggtctgaatgggccactcttcaggatctgtgttcctcactgagtaaggtggggcattttcagctgtgttcaccatcaaacaaaaataataaagacgaggaggaggagaaagaagagtgtgggcattacagagaaacacaattctgttgtatgaaaccactggagaatctgctggagaatctttgctggaaatgggattattcattcattgtttattaattttgaaacattttattgagtccaggcattgttataggtactggggggttaacagcagtagatgaaacatgaaacttcatgggctagaaagagacggcaaataaaacagatagatgaataacatatttgtatagggatcactccatgaaaaagacataactgggtgctatgatgagggcaggtggtacagaaggcctcccagaggaggggagattgaagcaaagacgtgaaaggagtaagaaagtaaactgtgtggatagtgaggaaagaggattctaggctgaggaaacaggaagtacagagacccaaaggagcttacttgagatatttgagtaacagcagataagccagtgtagctggagcagaaagattagaaatagagtccaaggaaggccgggcgcggtggctcatgcctgtaatcccaacactttggga[134 bp omitted]gaggccggagaatggcgtgaacccaggaggtggagc[138 bp omitted]ttttctgggctatggtgaggattttagatcttactgtaaagtaagatgggaagccattggaggatttgggcaagattctctttgtagccattatcctattctgattccagttctatcagtgacttgcctgtgtgaaccttttttttttttttttgagacggagtcttgctgtctcgcccaggctggagtgcagtggtgtgatctcggctcactgcagcctccgcctcccgggtacaagtaattctcacctcagcctcccgagttgctgggattacaggggtgcgccaccacgcctggctaatttttgcatttttaatagagacacggtttcaccatgttggccaggctggtcttgaacttctgacttcagatgtttcacccacctcggcctcccaaagtgttgggattagaggcatgaaccaccgctcctggccgcctgtgtgaatttgaatgagctcttgatccctcagtttgctgttaggtaaaatgtggataatgatacttaccccaagaggcattaaaagaattagctattggttacaaaaggctcgcagccttcaaatgacaggtatgatatagagtaattaccattattctgtatagtcgttattttaacacctgtcttcttttagaaatgtaaaaaatatatataaacttataccctaagtagctgcattgtggaaattttttaaatgtctaggaagttatgtttctgatttccctttgatttccatgagagagatttaggatattcctttcttctttgcaaaagatatcttaaaagcttctcagaagttgaaacccaacatatatcataaaatattagaatgagaagagaccttacaatttgttgttgggcagagtctgatttctacatagagatgacttttaaaaatattccttactgtccaaactgtgtgtttctagtgtatgagaaatcacatggggagagtagcttccaggctaggaaggctgctgtgttatttgttcaagttgaatgaaattatttgtagattgtggaaaaatatgatcttacagatcatctcgtctgatgtcatcattttacaagtgagtaaactgagagaagcagagtcttgaggacaatttcactgctggttagcaggagatactggctgagaatcagtatcataagactttcaggcaactgctctttctgagtgctctttcaggcatcatattctctcctcagattcataagctacctaccctagtgtcacatttagatataattgcaatgttagaggaagtgatttgctgtaatttcatatccctttccatgtccattgtaatgatgcactttgctaatatgggaagtggtggctgccacagaatttctttgcttggtgaggcagctgtatgtgaaaaaaaaatttctcagactataatttgactgtatgccacaaatgttttgctctgtattttctcttcttctgcctctctctttgttgctggctgttgactctgcaagtggattctgtaggctgtcccactgaagcagcagaatttcagttttagatttgaacaattcaaatataaattttttcatattatttttttcatgttacttttggcctgaaagatgtattctagttttgttatagataattactgtgataactttaaaaagcaatgtgttatacaaagttagtgttcattacatgttattcatttgaaatgacctcagcatgtaattttaagccttctattcccatcattttaatgagagatgtgaaccattgtcatgaaaataagcaaataggccaggcagggtggctcacttttgggaggctgaggcagaaggatcccttgagctcaggagttcgagaccagcatgggcaacatagggagaccttgtgtctactaaaaataaaaataaaaataaagaaaataagcaaacatgcatatataatcaccattatgattaacattttcctttaatattaatctagatttcttccagcaaacttaaatgtagattaattgaatatgagaatatatgtatatattctcacatatatgagatatgtacatatatgaaagatataaatatacccacacattctctttctgttcctttgcatactaatacaataacatttaattgactggcattgcaaaacaagctgatgttttctgctaggactcttttctgttgatagcacgtagcccacatggccccttcccgagatagaagctgtagcatttatcagtctaacctgttagggtattccttacactgatatatatttttgtcattcattaaaaaaaatcaatgatatttatacaagtcaaaaataaatatcaatgttatttatttttactggtttttctaaaaagaaatgtcccttaaggcttttatatattttgcttggtcatgctatggagaaataaattgatgtttcaggtactttgccagacgttaagttgttggcaagaacgatcttgccaaataatactctttccataattaaagttctcaaaatgatcagggatcatattggataatcagatgggtaattaaaaatgaccagcttaaattttaaagccaggttcttcgaataagacaagatgcataggaatgcatttcctcaataatcaccaggagctgctcttcccatctcaccctgaagtgacttcagatctgtcatcctgggaaattgcaacttgaataagctctgcctttcactgtgacaattgcttgacatagcctgcagtttgtgacttactgaaagaagcatcaattcatcagagagctcctaatcccttttctcacctcttttatcagactgtcaaagtctgtttttaggggagaatagagggacagcatgaactcatcaggcagtccccaaccttttcctgttcctgtgggctttgctgtgagttgtagcaacaggctactccttaactattgtgaatccctaactccaaacaaatggcatagttccattaggcctgttgatttaaagctcagcacttggggcactcgacaacaactggcaggcaactaatgactctgtgcttccctgtgagtgccctgtaaattggactttcagaagcaaagacagtggtacagtgtagatgagtacatgtgtaggtgagatggaaatatgtaatgtgggtatatgtatatatgtatatatatgctttttatgtttattcttggattcgtggtaatagaaaccaaattaaaatgatgtaatcatggtttgcaattaaatgggaaaagaatgctatagtgaaagggtcaggagattcagatatcagaatgctttatacatttcaaagtgttaagtcttaattattgttctctagatatttgattaactgagggtaaatcatgtgattttcattcactatcttagaaaaatgaagataatgataattcctaacatcttgtcagggttgtctgaagattgtccaggcacaattgcctggcaagcttttgaggtttttagttcagagaaactattcaaatgcaatgtatatgtaacaaatgtatcattgctgggttttccccatgtaggtattcaagagacgatatttttacttgacccaacttcctgacggttcatatattctcaattcctataaagatgagaaaaattcaaaagaatcgaaaggttgcatctacttggacgcctgcattgatgttgttcaggtaaggccattgaggtaatccttctctttttctaacagggttattgataaacttttaagaaccccagatggttgggtggggtggcttatgcctgtaatcccagcactttgagaggctgaggcaggaggatcgcttgagcctaggagtacatcagcctgggcaacaaagagaccccatctctacaaaaaaatacaaaaattacccaggcatggtggcacattcctgtggtcccagctactctggaggctgaagtgggaggatcacttgagtctaggaggttgaagctgcagtgagctgtgattgcaccactgcactccagcctgggtgacagagcaagaccctgtctacaaaaaagaaaagaaaaagtgactggtgcggtggctcatgtgtataatccctgcgctttgtaaggctg[134 bp omitted]gaggcaggagaatcgcttgaacccaggagtcagaggttgcagtgagccaagacggtgccactacactgcagcctgggtgatggagtgagactccatcacaaaaaaaaaaaaaggaaagaaaatgaaccttggcatttttccatcttgattgatggcatctccgtcctccgaaacatctacactagaaagctcagaatcctcttcagtgccctgttcttgctcagtgccaatatttaaatgtttatcaagtctctttgagtctggctctaaagtgcctcttaacctcttacctcctactttcattgccctttctccagttctcccttttatcatcgctggcccaaagttgcgcttttatgcctcctgatttcttgtcttgctccagttcaacttcctaagatatagtttgggtcaatcatttgccttctccaaatcttttggctcttgatttattgtcttacagagtgaactctaaagcttttgccctgacattgaaggcccatagtgatttggcctcactgtgctttctagcctcatccttcctgaacccccttgtgtattctgtgctctggtcacaccaggctaagcattctaaagcgttgcacacatatatggcttgccttacatttttttcctcttcttgctatatataatttctccttctattcccgtttgaaccttatcttttatgactcagcttaaaggctactgccgtgaaaagttttgtgtttccttcctcaccctcgtgactaccaagtagaattaagctccacctctcctgtgctaaccattttgcttttccttctgtcatacaactaagtcacattctaattttggttaattctacacattcctttggggattacagggaccatctcttactcatttctgtttcttctataattaccagggttctgcacacagtagggacttaatgaatgtttgttgatatgaattactgaggggacacagacagaaacaggatgggaagtagagggctgagagatgatctggatgggaagtcaattgactatggaacagaagtcattattacagagccagggtggtgtggtggactagaagaacaatgggctgattaggaggaaagtgatgttagttcagcaccctcagtttacctaaatcttcattttcagaactgtgaagtgggattagtagtatctgtatactctatcaaacaagattgttgtgaggatcaaatgagaaaatacctttagggcatgatgttgtgtgcctgtagtgccagctactcaggagcctgtggcaggagcattgcttgggcccaggagtttgacgctgcagtgagatatgatcacgcctgtggaattagccagtgcactccagcctgggcagcacagtgagatctcatctctaaaaagataaattaaaaaattctaacaaatgagaaaacactttttaaaaagtataaagctctatgtgaataaaatgtgcttatatgtatgattatatattatatattcatatatatgaattcatatatattcatatatataaagaagagctttcttactggaagaacgaggcacacacaatttccggattgacctttctttgtagtgcttccctcatctttttatttttattatcatttaaaaaatttttttcttttcttttttttttttgagacagagtctcactatgttgcccaggctggagtgcagtggcgcaatctcagcttgctgcaacctccaccttctgggttcaggcgattctcctgcctagagtagctgggattagaggcacccgccaccatgcctggctaatttttgtatttttagtagagatgttgtataactttctccttagttcagttaaaaccagttcttgtcacataaccaggaaagattaggcttgtggacacatagaagggtgagaagtggaatttactgggtgaaaaggaaaaataactctcaccaaagtgagagagagtcctgctagcaggtttcccacctcacagattaaaggttttgccgggaatccttggctgtctcctgtctctgtcagagatggggtttctgcatgttggccaggctggtctcaaattcctgacctcaagtgatccgctcacctcagccacccaaagtgctgggattacaggcgtgagccgccatgctcaggcacctcatctatttatgataccgcctcccaaatattttcaaatgtataaatctttatgacttgatacagcagtttaatttcatcctttcgtagacttcaaagattagaaggaggaactttcttggttccttcttgaataatgaccatgcagtggaaaattattgattcatgagcatttcttgaaattaatgctgagggatttgaaaagggtagtatgtcatttcttttttcatgacagagaaggtggtaaagtaaaagaatgtatcagcaagcttgagaaaaggaggagacttattttccttgtgtggtggtattcagcacaggttacttccatgtattttatggagagtcacaatttaatgtgaaccaactatggttgcatggtcttattttttctttcttttttaccaagccattcttcttcttctttgcttgcttgctagctttctttctttctttctctttctttctttctgtttctttctctttctctctctctctttctctctttcgttctttccttctttcccttccttccttccttctttctttctttccttctttggagtcttgccctgtctggagtgcagtggcatgatcatatctcactgcagccttgcagccttgaactccttgctgcaggcaatccaccttagcctccaaagtgctgggattacatgcataaaccaccatgctggggcttctctttttaatttttaattttttttttgaggcaggatctcactgtgtcgccccggctggagtgtagtagtaccatcttggctcactgcacccttgaactccaaggcttaggtgatcctcccacctcagccccacgagtagctgggactacagccatgcgccatcacgcctggctatttttttttgtattttttttgtagagatgaggtttcaccgctttgctcaggctggtctcaaactcctgggcttaagcaatccgcccacctctgtctcccaaagtgctaggactacaggtgtgggccactgcccccatctttacttttttgttgctatggatatggaatatttctacatattttgggggtacatgtgatagtttgatacaagtatacaatgtgcaaatgatcgaatcagagtaattgggttatccatcacctcaagtgtgtatcatttaattgtgttaggaacattccaaatccactcttctagttatgttgaaatatacaataaattattgttaactatggtcgccctattgtgctgccaaacactgtggtcttcttttatactattgtgatacagttgatactatgcgtggtaaaatgagttaggatctatagtgccttttatggtgagatataaatttatcagatttgtttcaggtcatatttaaattttttaaagtgctgactttgaaaatccttaaatattcaaggaaaagtttgaacggagtggaaattctaaaatgtttgcttacttttatggtggtactttgattttctgaatgtgaaggatgccaaaaggccttaaatgataatacttaacaagtattgttttctcccaactttatacatattcatactactgtgctcagtcctgagggaggggaacaaaaaatatatttaacatggtcatttgttgtcttagagtgtctgtttcttactgaaagaagcagttatttcatgaaagtcttgacgcacatatgcactaagctgagataaaaataaatataaactaatgaaatctaatagtaaaaggacaactaaactaactgaacacatactttttctcccctctagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaaggtcagaattttaaagtgatttattattgaagtaaagcccttgtctttaatccgtggaaatgtcctctgtgcagggtgagtagagaactcttaatcttaaaagttgacctgcttcttcattaataagtgactgtggaggttgatagactttttttaaacagttgatgctgcatgggctctgacatatgaaatataaccagactaaaacagatagaaaattcatggcaggttttcaaaagtccattaaagttttccctatgctttcataatagaaattctttgcaataaatcttgtaggagaggatgggtgggagagatagttaggatactcctcttaggttattagtaatggtctgtatggtttagaacatctgcttttaatgaatttgcagatgatgaaactagcagccaaggaaaagccgagaacatcatggcaagtttggaaaggagcatgcatccggaactgatgaaggtacatctttcatatggcaacttgccttcaactgagataatgcaggattagctattaaagttttaatgctggattccatttggcaatgtcatttccacgttaaaaaccacagcaaattggtgaaacaggtagagattgtaaaagaaaagttgcactcctgaagactaacttgtaagtaccaactgacagtttggaaaaatcttatttttttccagacaccaagaaatacttccaggcttttgtgacttcattaattttatctgctagttcttatttaatttaattactgtatatcattcataaaatattcttcttccaaaaggataatgatgcagctcatgcacatgatatttaatctatgaccaacatatgttaatctcacatgaaaatcatattctctatatgtaaatatatgtgtatatgaatgatttaatctgataaagattttggtgaacatgcatcatttttgttatttactctgctgtttgaagtttgaaatgaaccagttttgaaattgtagagatgattgtcctgagtatcttaccacgatactgtattctgtagactctatattatagtagattagaaggttgtgacccatttattcatttaaatcattgccaaatctatttatatttttactttattcatcttactggacaaattagttacacaaatttggaagctccttttttttttctattttaaatttacccctcataaacttca[131 bp omitted]cctccgttgccgaggttcaagtgattctcctgcctcagcctcctgagtaactaggattacaggcgcccaccaccacgcccagctaatctttgtatttttagtagagacagggtttcaccttgttggccaggctggtcttgaactcctggcctcgagtgatccacccacttcggcctcccaaagtgctgggattaccagcatgaaccactgtgcctggccttatcttataaaatgattttatagattttagttgcattccctctcaatctttgtcatcctggattgtgcagctccattaggtatttcccaaagtgatggaatcagaattacatataatattctatagctaacataatggctatgaaaactatggtgatttctcttttgtttatttctcctttgcatccagagtctcttgcattcctgttttgtactgactacaggatgaatggtatatttttgaagctgtgacagattgatagtttcacataaactatacatttaaatagtatttaacactgttttgaaggaaatgaagtaacatacttattttttaaaattttagtatggaagagaaactgaacaactaaacaaactcagtagaggagatggaagacagaatctcttttcttttgattcagaagttcaggtattaatgatacatttctttaatagtcctagaattattgcttattcagataaacaacatctttgaaatgttgaaatcactgtttttcttgcaccagtggggaatatagattgttttatatttgtcttgtttgctttgaacaggtaacttaacaaataactcttcactcaaggggactgtcacatatgcagataatttggggctgaattatatatatatatatatatatatatatatatatatatatatatatatatatatatttctcagtttcttgtattcttttcacttccttttgctcctcaaaatagataaattaaagcaccgttaaagatggttacagtgttcttttagcccatgaaatacaattgtgatctagtggcagaaaatatctccagtataaagaacatatgagtcatatgagacatttatttttcacatttgatgtaggcctgtagaactaggataattgtcatgtctggcttaatcacactttaaatggagggtggtgcaggaaggtgcaggtttatacgcggatgtgtattttaacctctttcatgagagttagatgtgttttgtagtaagatatatgcagttaatatttaagtctatgacattttctaattaagtttttaatttgtttaagtgggaaaggtctacagtatttaagtattacaaatatttttcctaatggaaaataccttttgaaaaaatgaaattgaggaagacgaaattttttggctttcttttccctttttctacatgagatttcgaatgaaaattttttatttagtttgaaatcggaaaatgtgcattacagttttttcttccacgaaaatatgaaataatttggggaagtctgattttgttgttgtcgttttttcttctttctttctttctctctctctcttctttctttctttctttcctttttttttttttttttttttttgagatggagttttgctcttgttgcccaggctggagtgcaatggcacgatctcggctcactgcaacctctgcctcctcaagcagttctcctgcctcagcctcccgagtagctgggattacaggcatgcaccaccacgcccgactaattttgtatttttagtagaaatggggtttctccacattggtcaggctggtctcgaactcccaacctcagatgatccacccgccttggcctctcaaagtgctgggattgcaggcgtgagccactgtgcacggcctctttttctttttttaagtgtagtcaagtacagtagtgacaaggggagaaagagtagaacaaaaagttcaatatgtaattgactgaacaatcaattgagataactcactacctttgggccagccattgttgtttttttctttttgcttcatatggttttctaattaaaaatttagtttaaaatagaaaaagtatataggctataaataatgcaaacattttccttaatgaaagtatcacacaagaaaatggaattatttggagaaaataaattttaaaaaataatttcatttccctttctccccccacggagttaaatattgctttagtgcaagttatgtgattttttttttttttgtaaaaaagtaacagtataatgggcctcagggatgtttgttctaagatattcattcagaaatttacttgttccaagcatgtctgagtctttgatcctcccacccatgactgggctctagttggacgtgttaggctgtttcattgtatacaaaggagccaactgactgtggttgaaactaaatccagtatctttacaaatttgtggtgtagcgtttttgtggtaataaaactgaactggttttatgtctgagttgtttatcagtgagctatggtaagagagaaattcacagttgtgatgaagctttaaggagaagaaattgaatgtaatgttggttatggaaggcagtgtcgcctcggagaaacccatgttgtatctgtcgagtaccttttctaggtgaggtgccatcccataattttaccttttcttttggccatagttcattgtttagagacatgaccttagagaataaagaaacactggctgattaaaggggatggctcaaacgtagagctgaagaaggccatgtgtcccaacatttgtactcacaggccttagaagggaaaggatttgaaggctggagtggtttggtccagtttctctttccattctactgtctgagtaacacagaaaggagagcagataaatgggtggaaattaaaattgatctccatggcaatgacttgcctccacagatggatatgtgttcaagagggagctgtctagtcccacacattcgcattccttttgtagataaatagattgaaaggtgaagaagtcaagctttcaggcacaaatcttacacattgggcccttttaaggaggtttcagtcagtcatactgggtaggttagaacagctataattatccagtattcttcaggcataatacctgttttggcttgaattacttaggtaattgagaaaaaattttgtgtttcttgtcttgagttttccatactgacagtgttattctgctcagatccacccaatcattttctgcctacaatgtctatggccttaatgaaagtacagtaaattgtccccacaatccacacttttcttcccctttgtgaatagaatataagtctgttcagacattcagcatgaacagatgaacttagattgcctgagcaatctttttctttgagagacagagtcctcccctactgaaaggaattccttcacacccaatatcttcttcttaaacttgtttttatttcaaaataccaataatttttaaaaatcgatttctgtggcagcccaggtccattgcccagctctgttagctgagctcagtgttgctcagtttcctaagcggatgcctcttactctgttcataagttaaacgtaggtagtccatggggttccagccttttgtgcctctcaacctaaatgctgctgactcccacgtccagatctctaagtcaggcctctcccatttttccaactacctactaccgtcaccacaaacacaacacatcccatactgaactcaccatttctactcactgtaccccaaaatctgccattcatttgtatttcacgactaagttcataacatcgttatctattgaatctcccaaattagagaccactgtgttaatcttttttttttttttctgagacaggatctcactctgtcacccaggtcggagtgcagtggcaccatcatagctcactgcagtcttgaactcttgggctcaagccatcctcccacctcagcctcccgaataaccaggattacagacctgcaccaccatgcctggctagtttttattttttatagagacaagggtctcactgtcttgcctaggctggtctcgaactcctggcctcaagcgaaattccctcctcggtctacatattagttttgatgcttcccatacccattcctgtcaattttgcatcctgcacagctcaaaaacgaaaccaaatttcgactgtcctggaacatatattgtgtggggaagacaaagaataaacacatataaaaagtaatattagaaagataaatgagagaaagggagtatagactgtcagggagtgtgcagttttctatagggagttaggaaaggtctccctgcagaagtgtcgactgatcagagacttggaaatgagggagcaagccatacagctatctgagggaagagggttcctgacagagtagcaagtgcaaaagccccggcatgggagtgtccttgttgtgctggcaaaataaccaaggaggccagtgtggctgcaagagggaagagggcaattgtggtaggagatgaggtcagagcagtgagaagagacagggaatcatgccatgtagggctttgtaggccatagtacagacttgtgacttttccattgcccttagatccgagtttcatcatctccctctaggatttctccatcactgtttaaccttagtgtaaaaagtctataaaagcttgttagatgaaaacataaaaagggttcaaatgaagaatggacagagaactgttggatttttgccattttttgtatattgatgtaaatcaatatgaatcccatctttttttgaaaatgattcatactatctcttttatagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgtatgtatgactttgccttctaccccccttgcatcagtgcattaaagaaatgtctttctcaaaataatttgtacaccaaacctccgtgacatgcaatttacctatataacaaacctgcacatgtactcctgaacctaaaatgaaagttttatatatataaaaaagaaatcttattacaataaaaaaatgaagaaacatctttgtatgactgagaactattaataattgactgtgtgaaaattccagtgccacatattatgataaatttgacatggaagaattttatacatctctttcttttgccaaaatatgactatgttctcattgtgaggattcatgaaaatcttacctactcagaatagcagatagagtaggctcttgatgttcaagaggagcatgtctcccaaacttgcaaaatcttcaaatgcgtaaattctactagataatatgttttcttctatgaaattggttcgtagcaatgagtaaggatcaccatagccatgctgggatacagatgctgtgcagtctgctaggctcggtcactattctatagcattagattcattttggtctacagagaaaattctaagtgacagctctcatggatcatttgagttgcttagaaatccttgaaactgtaagtgtaaaatcttcagagagacttttttgtgttcatctttattttttcgttctagttttgtctattaaaaataaaacagtgatgagggattctcttacaaaatagcttaaaagtacaacagacttttctgtgtgtaaagggttaatctttatgccatctggcatgaaatttctctttgtgaccatctttcaaatgccatctgtagagaggaatcatgtcttccaaaattgctgatagggcaaagcttttgtcaagtactttggtgttgactgttattagcgcttatgaaatgtatagtcaagtaagttggaacataacagaagagaagatttatttctatactgtaatattggcattattttttaggtagtttcagtaaacgtgtagcgaataaaattttattcatagaacaatttgtgttatttaaatgtagcttttgatttccatttttttggtaaactttataacttgtgaaattatctacacctgacggaagttaaaatttgatgaagtctgttgttttggaatgccctttcttctgtgcagataagccataatataattttagctaagtgttgaactcagaaaggaattgtaatcacagaaactggaggaatacaaaacttattttgcacttgtgcccctccccgccatgcccccactaaagtctcagttttaaaatgtaactgttttcattcccaggttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacaggtaacgaatgacctttagtcttagcagcgtattcagaataagaaacagaaatattcttgtattatttcatggtttcaggccaatgttttcatggcattctctctcttgtaaggtctgtcgatagagatttttctggttactgaagtttgagggcaaaaatggaaaccaatgaacatgctagtaacatgttatcaaaggaacatttttaatgggaccatgatgtgagacacaagggaattattttgtgagatagaaagctgaaccaggccaggcgtggtggctcacgcctgtaatcccagcactatgggaggctgaggcgggcagatcacttgaggtcaagagttcgagaccagcctggccaacatggtgaaaccccatctctactaaaggtaccaaaaaaattagccaggcgtggtgatgtgcgcctgtaatcctagctactcgggacactgaggcaggagaatcgcttgaacccaggaggtggaggttgcagtgagccgagatcacgctacactgcactccagcctgggcaacagagcaagactccgtctcacaaagaaagctgatacagacacccataaacacacctgcacccacactcatacatatacttctaagcaaggcaataagtgcttgaaagttttggtttttaagaaaaattgaccctaaattaactctcccacccctgattttcatgtccattatgagtaggtcatttgaatggagcatatgggctctttatacaaggagttttacttgaaaagcaatgggcgggaactgcttgtgtcatagctgtaatgctacactcttctattctatctggagcaaagaatccctttcagaaagagcttaactgttccttggaattctgacctctgaccagactagaggccataagaagttagccgagtggattgatcatttgctcgctagacttttgcagctaaaaggaaatgagagcacggcatagaattaaaagtagaaagaggcatatgaacaaagctgttcatgttgtaaggagattgatttttttctaaataaaaatactattctttttttcctgattataataagtacattcttatgtagaaaattcaaataatataagaagtataaaaaagaaagtaaaagtctccacccaaaagacaatacctattaacattttggtaaacatcttttcagacatctctgttgtgtatatagaaatatatacacattatgtgtatgcttataaaaattatattcatgctgttttatacctactgtattcttttaatatcatatttatcatcctataccaatatctatagatcagtcatatttatatgaaaggctaacatgacatttcattgatttagctacttaagacatttctaattatttgctatcagaaataatgctgcattgaacctcttgtgcacacatcttagctcatttgttgaattatctccttagaataaattccaagcattaggatttttagggtcaaagattatgctgatttatatagatgatcaaacattggggaagactgctttacatggactgtcactgtctttttggggctgtggatttctggtggcttgtcctcaagttgtcccttatcccctgatagccccttagcttgttactgagactatagttgtcacctctgtgaacattccacaatgatggtggatgcttctgaaagagggatggagcaagtaaagtgttgtaaatatttgagaacttgctattgaattttatgtttaaaatttcctgcacaatatcaaataagtcattttaagccaatgtgtatttcccgtattacttcagtgtgtagcactcagctgtatgttcaatgcaggaagtttaaattatgatttcagatgtcatccagtttgtaatttggaacaggaagaaaatcaacatttaaaaaagatctcctgtgtgccaacattattccatcagtgtctcatgtaatcatactagtttgtgaaatgatataatcactactgtttgacagatggcgaaactgaagctcagggaggttaagtaaactgctcaccattacacagctagtagtggtgacggtaggatttgaatttaggtctgtttgaaataatttgatcaagaatattagacaaatgtaattaagtgccgaaatatataaccctagcacatgccctgccacatcctgggagctttgtaagtgctggtggctggggtagaggacctggcccattttctagcgggaggggccagcaaagtgggtaagagtcgccctggggtggggaggcatattcatgccccttggtgggaaacaaggactgggccatagaccttgtcctaaacggccagacctccagcccacgtgggatttctgggttctctctggccaccttttgcattctggggacagggagaggaccagaagctgttgggacaaaaggtaaaacaaccccaaagagtgtcccccatcattggaatccctggtcagttagaaaatggacatctctgtgcctcagcatccttatctgcaagtggaggtggtgacagtacctgtctccaagggctgtggggaggcacaaataaggtgcgtggttctaagaaaacactcagcactgtgatgggcacactgggttagcgcagtgcagcgtagcagccaggagtagtagcactgacagtgatctcaaacaagtgaaaacagcaagcttttatcaattatcaactatcttaaaattatagtcctcattgctggcatcagtaggaaatgcttagagtactgggaatgggaaacaataggtgctcagtaaatgttagctatagcaataatcagtattactgttctcaaactcctgggctcaagcaatcctcccgcctcagcctcccaaagtgctgggattacaggcacgagccaccacacccagcagtattactgttctaatcaggcctcatcatatgagatgttgggtgtatgggactcagggctgagagagaatatagcatgggctgtgtaatctggaagcctgaactgcaatcttcttcacccacttactcactgcacaaacctttctgagcctccacttcttaatctatagaatatgtatatagtagtgcctacatttcagggtttttatgaagactgaatgagataaagcatgaaaaccatctagcatggttatgtggcagttagcgtaacactgcactcaaggtgcactgctcagcataccttctgcagggacagcccgggcagtctgccaacccgttcagcctcacagctcaaacagcatgttcccggcagtacccgaagccaggttctgtgaccttgggatgctttggtgggccacctgggtaatagcaaggtacctgatgtgcattacttcatttaatccatacaagaaatgtatgaaatcactactatcctgctatttcacagatgagaaacctgagacttagagagaatgtgacttgcttaaacccataaatgttggagccagaacccaagaaatttgacaagcaattttgaaccactttgttcactttctcaagcaaatttgaaccactttgttccatgcttgctgcttgggaattcaaagctgaatcagccattacgcaggatccttataagctgtttgacttgggggaaatcattagcctcttaacactcaattttctattctgccctgtctacctccaagggttctatctggtacaaatgagataatgtgtctgaaatgcattggaaactggaaatcactatattaacaaagttggtaatatatcaaggaaaaaaacgaaattttggtagagactcagtgatagatttttccacttgaattcactagtgatgcccctttaaacaacaggcataaccaactaacatgctatgtagatgatattatatttggaaggagtcaaactggacaggaggtgttcctgttccacatgcattcaaagaaaaatgtaattttggttgcatctacattagtacatttaagtaaagtgtatggggacaaaatgagttttggattctctgtctcctacctttgcattggaagcaccagagctcttgaactgcaacaaaggaatgtcttttagaggatgatttagtttttctatattagagcagtaaagtttctttttccttcttagtggaaataaatattagttaaatattaattgctcttgagttacatgcagctgcatttaaaaatgtatatctagttccactcgagaaatgtactcacttcgcatacacaaccaaaccaaagaggcaaagcagcaacggtgacacctgcgctatggagactaacagatgtgaggttggtgacaaaatataaaatccattttgaaaggaacgttggaagctttgaaaactctatgaaaggaaattctatctatttctagggtcctggacatgatcctttgttgaatatgaacattgtttactaaaaatcgttaaccataaacaaccatatgcacaagattacataagaaagtctaacggaagtacttttttcccagggaattttctcagtgacgaatccacatcctgaaatttttctagttgccagaattgaaaaggtactacagggaaacattacacactgtgcagaaccctatatcaaaaattctgatccagtaaaggtaatttataaaggttgttgatcaacatttcaccttaacgtagaatttgccttttactgatattttaaatgccattgctttgagcatgctatatattctgaaaacattgtatactgtgtatgtttgctaaaacttgaacatggcatattttcctattgtcattgatgttctgttaatgtgataatctgatttctgcttgattatcaaaataagagccaaaagcttttaggcaacatctgctaattgacaccatatccttgacaatagccgttcttttccttacagccctacatgaagtgctagaatgaatctcagagctgggagattaaagatgatccagtcctatagttcccaaatgtcagttcatacccagatttactcctgtctgtgatgaaacgagaaaagaaagacagacagtgaacatttcatgaagctaaatgtatttaattcaaagggctgccctttattctgagatctttgcccttcctactttttaaaggttatgcgtatcttcctttcatgaaatgttggcatattaaatggcagggatttaaaaaattattgttgagtgtccttaagtggcaatattaaaagttggcaaccctatattgtcatccagatttctagaaaattgtgaaattgtgaaattcaaatgtttggaaatcatcgctctaatctcatcctctccttttataaatggaaaaactgagaccccaggagggaaaggttcatggttgagttcattagtagcactccagctactgtgtatttatgtacatcaatctgttgtacatggcattttgttgtatacccaaatagtgtttattaaatggaagttgctgatgtgatgggactaatttgtggaggaaaaatgtctcaacaatatagataaaagcctccagcattctgtatccctagggataagcatccagccagcatttcgagtctgtttagactctataggcagtttatctccttgtcatctccctgtgcctgtgcaaacagcagctcctgcccacacttagactaattgccttgactcctggtgacttgctccttgtcttgggagtagaaagggcagctgtatccagaaaaaacttctcccaagaatgatgagcatttgcctgctatgtgaagtaaagtacatgttaaaaccactgaacatttttccagtagaggtcttggttcaaagtgtgccctatatctatttcgtctgtcttctgctataagtgacagaagctctgttaatgagaaaatccaaagcctttatgaaatactttggacttgaaaaatggctggctgatgcatgttattctgcttgtggctatttctatatatttttttgagatttttgatgttttgtaatggtaggttggggaaattatttttctgggtgggtccatggcagtttgaacaaatacaagcctatcttcttgtttctgaccttagacggcccagaaggtgcacaggacagctaaacaagtgtgtagccgccttggacaatacagaatgcccttcgcttgggctgccaggtttgtacaaatataatcctgacccgctcactcgtgttcatatgtgaagttaagggctgttatacttaccagcattcagcactgtgtttctggcaggccagttgtatcttgggacacttgggatgtaataattattatttttgttgttgtttttgagacggagtttcgctcttgttgcccaggctggagtgcagtggcgcgatctcggctcaccacaacctccgcctcttgggttcaagcgattctcctgcctc[219 bp omitted]gaccctctcattttttttttcatatgtcttgctttagggaagttttctttggctttggttactgctctgactgacaccacttaattttactgcatttaaaagcagaatttatttggtagtcatggaattttttcagaaaagcagaaattatagtgagttatgtacagtataccccctatttcagagttggttgtgtttatgctttgaaaatctatcatagaatatttctggaaaacatactgaaaattcagaggcaactaatgaagtcattaaatgtgagtgtgtaattaatgtattttcttcctgatgacaaattctgccagcatgtgataactatatttcatatctgatggtaggttacattattttatccaaattttgtaaatccatgcagggatgacttaaaacaagtttcttgtttttctccctttttcaagtacaggttcactggcttgtttgtggtacagcctgtacagctcactggggcttctgtggaaaggacaccatgttctgaataattcaatcaattatgttcagtgggtgctagggagtagcataagggtaggagattctaagttaattaactcttttatttgtcactatttataatcatttcattttgggcaaggtctcaaaatgtattgtatgttggtggatgaaagatcactattgtccttgttttgcagactggtaaaaaaaaatgatagctaggggtaggtgaatggcaaagagtagcagaggttggtgtatgtaggcattatagaaggtgaagtatggcttataaatatcagcatatttttaatgctccagcctgaaaagtccattgctgc[184 bp omitted]ggtggcgtgcacctgtagtgccagctactctggaggctgaggcaggagaa[131 bp omitted]ttggccggccacagtggctcacgcctgtaatcccagcagtttgggaggctgaggcgggtggatcacaagatcaggagttcaagaccagcctggccaacatggtgaaaccccgtctctgctaaaaatataaaaattagccgggcgtgatggcaggcgcctgtaatcccagctactcgggaggctgagacaggagaattgcttgaacgtgggaggcggaggttgcagtgagccgagatcacagcactgtacttcagcctgggcaacagcaagactctgtctcggggaaaaaaaaagttatcaagtgctaactctgttcaaggcacttatctacgtgcttcatgtctattgtcttaaaaggtgggtactgttatccctgtctttgaagatgaggaaattgaggcccagaagtgaagcagaaagacaaaaatataaattattttccaagttcacacagcatgtggcagaacatggatcagaacccagggcacctgccttcaaagccatctctagaccactgtggcatacggtccctctttgggccataccagtagctgcttgatgccgttttaccagtagaaaagttaattttgaagtcttcaaagttagaagctttgatttccagttctaatgaggaattaaggtatttttttcctcctgaattgttttggttctcagcagtagtaaaaacttactcaaaaggctgggctggatgtttaaaagatatatgataaacctctgtttactagaaataaaggaggtatgcttagcgaaggatatgaacagacacttctcaaaagaagacatttatgtggccaacaaagatatgaataaaagctcatcatcactggtcattagagaaatgcaaatcaaaaccgcaacgagataccatctcatgctagttagaatggcggtcattaaaaagtcaggaaacaacagacgctagagaggatgtggagaaataggaacgcttttacactgttggtgggagtgtaaattagtttgaccattgtggaagacaatgtcacgatcctcaaggatctagaaccagaaacaacatttgacccagcagtcccattactgggtatatacccaaaggattataaatcattctactataaagacacatgcacatgtatgtttattgtggcactgttcataatagcaaagacttgggaccaacccaaatgtccaacaatgatgactggataaagaaaatgtggcacatatacaccatggaatactatgcagccataaaaaaggatgagttcatgtcctttgcagggacatggatgaagctaggaaccttcattctcaacaaactaacacaaaaacagaaaaccaaacaccgcatgttctcactcataggtgggagttgaacaatgagaatacatggacatggggaagggaacatcacacaccggagcctttcggtgggttggggggctaggggagggataacattaggagaaatacctaatgtagatgataggttgatgggtacagcaaaccaccatggcacatgtatacctgtgtaacaaacctgcacattctgcacatgtattccagaacttaaagtgtatatatacactttatatatacacacatatatatatatgaagtaggaacaatggagttaattaatgcctattaccacatcttcagaggtatgctggggggaaatatgtttcaggctatagctgcttccagtgtgttgggtgcgtgtatattgttttccattttagcagcagaatagttgcttaaaaatgggagaagaggaggggaagggaataattcaagttcatataggaaactatacatatatagtcatccctcagtatccatggggcattggttccaggatctcccacagataccaagatctgcaaatgctgaagtctctgatataaaattacgtagtatttgcatgtaacctattcacatcctcccatgtactttaagtcatctgtagattacttataatacctaatgcaatgtaaatgctatataaatagttgttatactgtattctttagtgaataatgacaagaaagtctatttgtgttcagtacagacacagttcttttttccaaatattttttatccatggttttttgaatccacggatgcggagcctgtggatacagagaaccgactctacattgtaatctccccatataaatttatccttatgctttttatgaactttatggaaatatacttcacctttgataaaatgtacatattttaaatgtctagcttcatgaattttcatgaatgtatacagtcacgtaaccaccaccccaaccagatatggaacatgtctattaccccagaaagtttcctcatgtcccttgtccattcagccatcttatccctgtcccaggcaaccactgatctgattttcattgcagatgacttttaatctcttttgcaccttcatataaatggaatcatgcagtatgtcctctgatgtttgctttcttgtactcagtgttcttgagattcatccatattgttgtgtgaatatgtagttcattttgagcagtatcccattgcgtgaatatacagcagtttgcttacccattcactttttctgggttattactagtttggagctatagcaaataaattggctgtgaacatttatttatataaatttttgttaaattgctgctgcgcaaattaagaacattcatgtaccatgtggaaatatgcctaggagtggaattgcaggattgtagagtgatgggtgattaacttaatgagaaaccgccaaactgtttccaaagtggtttcaccattttacatcccgaccattgctaattttatcttaatttatcaacatggaatttttttttttaaaaaaatgcttctgttgctgttttagacccattttcaaagatactcaaggctctcttgatctggatgggagattttctcctctgtataaacaagacagtagcaagctttcaagtgaagacattctcaagttgctctcagaatataagaagtaagtgtttggtgtttctgcaataagtaaatataatagatgaatcctcagttttttaaaatgatgaatgtgagtcatatatgggaaaaacagaatgattaaaattgtaagtttggatagagggtaaccagtgcattcagtaatcataattttaactctaaaatattattattttatacccaggccagaaaagaccaaactgcagattattcctgggcagctaaacatcacagtagaatgtgttcctgtggatttatcaagtaagaacatattgcaaataaaccttaagcataatgtttgaatgtcaggttgttatcctttcaatatttttcttgaggtttacgtggcatattagtttcccagggttgccatagcacaaagtactgttacaaattgggtggcttaagacaacaaacatttattctctcacagttccagaggctagaagtccaaaattaaggtgtttgcagggccatgctctctctgaatgctctagggaagagccattccttgcctcttcctgccttccagtagctcccagctaaccttggcatcagttggcttgtggctgcatcactccaacttctcctctgtcatcacatgaccttcttataaggacaccagtcattggatttaaggcccatctaatctagtatgacctcatcttaactaattgcatctacaaatatcccatttctaaataaagtcacattctgaggttccgggtggacatgaattttgagtgggggcgtggatgcttttcaacccagtatgcacgatgaatagttacagattaggaagtgaattgagttgattttatcagatgctgtttcatatatacgaagttgtgagtgtgtcccagtcaggttctattgccttttgcctttggtaacttttacttctgtcatcaactaagagatgaaaaaggagaaggatttcttttcttgtctaaggacaagaatccaagatcccaggagaaaaatagaagacacaaaacacaatttgcaagagataaaatgaagtagctagtaaatatgtgaaaaatattcaatcttagtaataatgccagtaaggcaaattaaacaatatgcttttgctcatccatcaaatctattaaaatgtttaaagtgaagctacctaatgctggctaggttttggccaggtggtatcacctatcatgagtaggagtacagtttggtaatagatatccatagatgttcataagtagggcattccaattctgagagtatatgcattcattcactgaataactatctattgagtaaacgtttattgactaccaacgaggtgctttaaacgtagggagtttaaagtctagaaggagtgacagatagtatgcaagcaaacgagttgtattactccgtttttcacacggctataaagatactacccaagactgggtaatttataaaggagagaggtttaattgactcacagttctgtatggctggggaggcctcaggaaacttaaaatcgtggcagaaggggaagcaggcacgtcttttgtggtggcaggcgagataaatagtgaatgaaagaggaacttccaaacacttataaaaccatcagatctcatgagaactcactcactatcacaagaacagcatgggggaaaccgccccatgatacattcacctcccaccaggtctctccctcaacacctggggattacaattcatggtgagatttgggtggagacacaaagcctaaccatatcacaagggcagctgtaaaaagggtagccagggaacacctgtcttaagctcaggaactgaagagggagaaagagagccagcatgtggtgattgggactgaacattttcagactgagggcatcacatacgttgtaaagaccatcacatatatatgtaaagaccttgaggtgagaccaagctgggtttgcatgaacagaagggaatccagtatagctctagtgtagtatgtgatgggaacagtggagataggagataaaataggaagcatcaggtcatgtaaggaattgtgttgactgtggtaatgccttaaaaaattgaattttattctaaatgcagtgagaagtcaataaagaatagtaaatggaggtgtggcatccactttatattttaaaacatctaagagtacaatggattattttttcctaaagaagcaatttgaaatctaggcagaaatggatccataaagatgttctttgcagtgttatttatattggaggaaaattggaaacaatcagaatccaacactgtcagtgtggttaagataatgatgctacactgataccatgaaactttattgcagccattaacagcaatgtttacaaagagttcatggaatgagacatcagataaatgtcgaaaaatcaggataaagttctatatatagtgtaggattttcatatcactatatacaatatgcatagaagactaaaagaagatatgccaaagtctcaacagtagttatctctgggtggcggaatgagcaactgtccttgtctaccttcactgtctacctccagatgctctgttataggcatgtatcactgtaataatcagaaaagcaaatccaacaaaaaatacagcatcctcaggtccaactctccctgggtcttccttcatcattactgctctgcagcaaggaccagcagtcttagagccccttaagtatatgaataacctttactacagtgacgatttcaataacatatgctgctaaacttctctgaggcttagtattttttcacggtcggggtattgagtttatcattggtaacacatcgtaagatcaaaaggcctccattatttcttaggtgaaaatttgcacctgtaccaagttagcttttaaaaagtgacttgccatgaactaattggaagcataaatttaccgttatttccctgataccaataaaaatttgcagtgaaagctaaattgctgccacaggagggaaaatgaaatggatttctttgcagagtttaaatttgtcaaaattatgatgtgttatatttggcaaatcactcgacattgagaacgaaatagcactccacgtctggtatgaagggttccactaaaatcagcatcagactactcagtcttgtctttttgggttcttaaagttgtcatgtgatttttttggtcaattactaagaattatgttttttaaatcgctctttgagaatgcaattcatgtatattttttatacatgcaggaatgtgttaatgattattaaactgaatgatctttgcctgtttttttccctgctatagattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggtaaccatgtaaactatacatttttggagtataaaatgttatttataatctgctaattgtgtgactcattttgactgattaatcattttaggcaaggaacattgcagtctgtgtggaattccgggattcagatgaaagtgacgctagtgccctaaaggtttgtttatgatattgataggcatatgtttttagtagagatggagattttggtactcagtagtcttatgctctaggtttaatttgtatcaacatcaaaaagaaaatgttctaaagtgacaaatgtaatactttcttttctactcttacatattaactataaggcttagtttaaatattaatgcagtaggagcatatatagctttaaaaatgccaggttttggcttttgctcctttttgattttgcaattgcttcaatgcccaattgcaaggtcgttttcttatgacctgatagtttataatggtaccatcaagggactataaactcctttctccttgaaacctgaacaggctttgagctgacagaagcacagcatgactgctttgatctgagatacgacttctactccgtgactggccaaatggtgcctccagtcttggattgtggtctatgaaaagcagaatctcagtcttatctgatacagcaatccttaaatacctgtcacaccacagtgcctttatatttttactctttataactgtaacccatcaatcagggacctgaaagagaagtcagaacatctagccagcaagaagtgtttatttggctccccatttctcttgcatcagcctaaatcagacagatggatgctgggtcttacactcaaaccacctagggaaacaggctggaatgcccctgactaagtaattgaataatagcccctacctttgaaaagagattttttttttttatgtatacagagaaacttaaattaaggatttgctggctcaaattctgtatgttttctctggttctctgttcagtggagatgagaacaactgctctatttcctccatgcaatatccttttgtagacccaatgactcttaggttacttctcagcagttcttgcaaattgccttcataaccatatttaagaagagttggatattcacttatatggagtttcaatttcatttcttagctggcctggattgctcactctaaagtaacagaatgaggcaattagtacgttggcatgctgactccatattcatccttgagcctattaggcctatagaagtgaaaaaatcccactagaaatgaaattggatctttccttggaaccatagaaagccttacatttattttattggtataacagaaagccactgatattttaaaatgtggctcataaagtgccacatttaaaaatgtgagagaacagcaagcttgtctgtagcttaatacacattcaactttttaattcctttaggccaggaatgtgtctgctggagctttttaaacacgcttcaccttgcccactgcacaaagagcgttcaacaaatgttgccgactggttgagggggagcctctcatattaagaaatgcaagtagcataagagaagtaagctttacaggcctggtttgagacaagtatttcccttccaaatgagtaggcctgttcagctccttactgtcaactagtttgagatcgtgtttctttgatggctggaaattcagaagcatccatacagccaagttacatggtgtctcatttggtgtctggagtgactgtgtaaatgattgggaatttacaggctcacggtgactgccaggtgggcttggccatggccctatagtcacagatgcctctaactatatgtggttccatggcatcacatttacagacctgcatttagagcggtgactctgtttctttcttttgcagtgtatttatggaaaacctgcagggtctgtttttaccacaaatgcttatgctgttgtctcgcatcacaaccaaaatccagagttctatgatgaggtaaaaatatattatcctgacatttctaaaacacagtggttggaattctttttctctttgaatcattttcatcattttaccagcactttcaatccctgagtgttttgttccatgaaaacagaaaatattacaacaaaacagagtgttactggcctgcttggtgccttttgatggtagtagaagatttaccccccaatttaaggggctcttcgacttgaggtaacaatgcaggaaacaaacatgagagtagagctagggttctagccctcctagctttgacagtgctggctctgtaacatcaagtcacttccccctccagagtctccatttcctcagctttaaaatgagaaattcagaagagattttcagaatgcctttctagctctttccccttatggttttacacagtagggtgcagcctctctgtaactgaaatactaggaaagacagggatacagctgggccaccagaatcccactggctggcctgcatgcttgggtgcaaagcacataaaggggtatggttgggtctctgagcctctgtggttcctcctgactcagcctctcaaattgtgtctctgcctttgaaaccctgtctctgcccctctttccttcttcctacttctccacctctacatctctgtgtgcttcccagcatgtctcttagcatctctgtcacagccacttctggtctgtatgtatccagcatatccaaatctgtagtctccttttgattcctatatgtctctatggaacctggatgggcatcccagcccagacgttctgctgtccctgcttctcagtccacatgtctccattcttggcttggtctgaaaccatccccccggctgtggtgattttgccatgtccacctgctgttgtatggaagccttatatcccagccttaggccttgctcatttccttctcaatccaatgtccctagtttcatgggggatggggaggggaatagtatttttgccacccagggagggagtatgcccatatttatgtgcagcagagcattacatacccagatggtctggatgctgtgaataggcatgttctgtagtgaaatagacctaaaacggacattagttataacatcaaaaccatgctttgtatgaatgataattggaccagatgtccatcaccaagttgtttaatatgtgtatctctgtaaccaacatcagtcactacaaaaaacttgatcatgtagtaagtaacccacattatttttaggatacctaaaatgaacatgcttttctttttttttttatagctctgattttttaatattccccttttttcctccctaatcattcttttcttttttattattattattacactttaagttttaggatacatgtgcacaacatgcaggtttgttacatatgtatacatgtgccatgttggtgtgctgcacccattaactcgtcatttagcattaggtatatctcctaatgctgtccctcccccctccccccaccccacaacagtccccagagtgtgatgttccccttcctgtgtccatgtgttctcattgttcaattgccacctatgagtgagaacatgcggtgtttggttttttgtccttgcaatagtttgctgagaatgatggtttccagcttcatccatgtccctgcaaaggacatgagctcatcattttttatggatgcatagtattccatggtgtatatgtgccacattttcttaatccagtctatcattgttggacatttgggttggttccaagtctttgctattgtgaatagtgccgcaataaacatacatgtgcatgtgtctttatagcagcatgttttatagtcctttgggtatatacccagtaatgggatggctgggtcaaatggcatttctagctctagatccctgaggaatcacctcaccgacttccacaatggttgaactagtttacagtcccaccaacagtgtaaaagtgttcctatttctccacatcctctccagcacctgttgtttcctgactttttaatgattgccactctaactggtgtgagttggtatctcattgtggttttgatttgcatttctctgatggccagtgatgatgagcattttttcatgtgttttttggctgcataaatgtcttcttttgagaagtgtcaatgaacatgctttcaatcattcactgtatattgactgagagagacagagagaatatttgcacgtgtacctttgtgggtacatgcatgtgcatcaaatcatttaaatctgtaatttgtctcttacatacttccaggaggcattacaaacattcggttgggatctgattagaaaattacttgtgatactttattacaaccattaatttttaactaagtttgtatgtcatggctgataattttcatctttaagagcaaagttgtgtttttcttctagagaaatttctataaactataatttgtggatactataagaccatcgttactttttgcatatttatttgtaatggcttaattttttcatgcaaaagagagcaacaacttagaaaaaaagttgtttttcagattcagtgtacattttaaatgggttgcattcattgatgcagattgagttgcatagtatccctgggctgtgatgatgtagttttgacttagtgttttagaaaattctgctgcaaaattgaatccaggagaatccattgtactctccagcaaaagtaataaatcaactctcacaactcagaatattgctgtcaaattgaaactgaccagaaaagcatttggaatatatttaaatgatacctactatttggccacttggccagtcctttaggaagtatttttggagcagtatgatgaaactgaactaatgtctgacagtttcagcttgagaaaacgaagttccatgtgtaattttgctttcatttcagattaaaattgagcttcccattcacctacatcaaaaacatcatttgcttttcactttttatcatgtaagttgtgaaattaacacaaagggaacaaccaaaaagcaagacacagttgaaactccaggtacgtgttctctttaaatgtctctctctacagttatttgaaatggaactgtccagggtataacctcttttcaccaagctatagaccacttctccccttgaccaaaaaccactgtattagttcattttcatgctgctgataaagacgtaccagagactgggaagaaaaagaagtttaattgaaccttacacttccacatggctgaggaggcctcagaatcatagcaagaggtgaaaggcacttcttggcagcagcaagagaaaaatgaggaagaagcaaaagcagaaacccctgataaacccaccagatctcgtgagacttattcattatcacaagaatagcacaggaaagagcggcccccatgattcaattacctccccctgggtccctcctacaacacctgggaattctgggagatacaattcacattgagatttgggttgggacacagccaaaccatatcaagcacatttctgattttaaaagttcattggtaaaatgcatattatatgttcattttagtatttctaccaaatatcattgtccatatgcttgccaatgtgcttagactactataagcaacataaagtaatattgctattctcaaaaagaaacacatattgcgatacagtatttttgttatttcttttatgtagaattgcccagcaaccagaattttccagttctgctcactgaggaagagggaagtgagcccagagccagggacatctgtgagccagagggaggttgggggctgactagttctaatgagaagataactgatttaacaaacttgaataagcttcagcagtgaagctctcgtcatgggcccattcagcaaggctttacgtaaaccaatgggtagcacccttagcagaaatagaaggccttgtgaacacagcttgtatcacaagcactttacgaacatcagcatgtcctaagattcagatcccagctagtctgtattattcactcattcattcattcagcaaatatttctgcatacaggttgagcatcccaaatccccaagtccaaaatgctccaaaattggaaactttttgagcactgacaagatcttcaagggaaatgcttattggaacatttcatattttggatttttggatttgagatatcaactggtattatgcaaatattctgaaaaaatctgaaaaaatcagaaatttgaaacacttctgttcctaaaaatttcagataagggatactcaaactgtattatgtacaagatattgtagtaggcactttggagaatacagtggagaatcaaacacagatctcatcttcagtgaggatatgatctagtaagggaaatgagtcctgcgtaaacaattataatacaagatagaaagtggtgtttaagaaagtagtgctacgtgaactcagaagagcgagttattcagctggtggagagacgagtggctgagaatcagagaaggcttctaggagatggtgtttgagtgaggccttaaagggttgggtggggtttgataatgcaacaatggcaggaatgtaggggattatggggtgaaggaacagcttgtacagaggcagagtatcaagaggcatggacaggaaaccacaagtagttcactaagcctggagcacagggtgctaggagggggatcataggatgtcaggttgaacaggaggcatcagattttggaaagccttgaataccaggctatagattttattttattctatcaccacagtagaactattggagggttttaaacattagagcagtttttcaggaaaaccaaccaggcagcagtataatgggcaaggcaagtagaagcaggaagaggaagaaaggaacaccagttagagggttatttcaaaagtccaggaaaggaagaggccacactatggcagtagcagcgggggcagagagaaagggaagtgcagaagaagaacatattggacctggaaagtgattggctattagagagatgatttagttagcaatgaagtttcaaaactgggtgattggaaagaaggtattgccaatagcaaaactgtgggtagggatggcaggtttgggacatcagttgagttttaggtgctagtgagacattggagtgatacccagcaggcagcaggactgaatatgagggagttccctttgcaggtagtatggatatgttctttatccccatagaaattgccgttagttcagggtaggggctttgaggattgagaagaaaactggcagaacgatgagaacccatgaccatgtgtacatcctgaaagctaaattactgattcattatccaaatcctagacagaagtggacaagatgctcagcggagcatgaaacagttattccgtgtgccactcatcactttgaactgtgcattctttaagtggcttcccacctttgagccagatggtgtgcttgacattgtacctttatagcttccaagtgctctctatgagttttgaataggggaaacgcttggtcgtgctctgattcatttacagtacaaaaatgttgcctaagcaatcccacagagacagaaagtagactatcggttgccaggggctgggaggagagggaaatggggagtgacttctaagggctatgggatttattttgggggtgatgaaaagttctggaattaagtggtggtcatggagatacaactttgcaaatatactaaagaccactatatgtacactttaaatagatgaattgtgtggtatatctgaatgaggtctcaataaaaatttctatttaaaaatgttgcttaagaacaagaaatagattttcctttcattttcctattttctgggctggaaatcttttctcatttgtcaaatttttagtttaactactttgacagagtcatttctaatggttcttctgctcatgttactttcctctgctttttataaaagaaaaggtctgggtaaagcatttctgtagttgaactagtaaagatgcccgtcaggcacatttcggagtctgagaaagccatttagtctacttagagaagcaatgttttagtctccttttaagaattaaagcatttgccaaattaaacacataaatgaaaacattctaaccagatttgtgttgacttctgtgttcacagtatcacacacacactcacacacagagtcacaaataattttaaagaatcagaaagcagtagctttaaaaaatgttctccagccaataccctctctcatatgccaaaactcagtccagagcaagcttttttacagctgagttataaacacttgaatcccagagtaatttctataatggaaatactgacaccactcaacttgagtaacacagatggctctggcttttttagctagaacatgatgagttttctaattgaaagccaaaaggctcttttggggagaactgttaagaaatgtagagattggggaaaatctcttgatggattcaagtcataaacactatttcctgcctgcattctcctacctacacctacacctcttccttctgtaatcaggacaagtctgcctaactaaatgatttatgcctactgccttgtataaatatggagtgtagccgtgactttgtgaccttaattttccatagttccttaccctagggttgccataagaaattttggaacatgtgattgttatctgaaatagtctcagccgtgagactctgcactcttagtgtaagaatggatgagaactatctgagccttttgaaaataaatccaccaaaaatatttcccaaagcataaagataatggtatcgatgcgcttttaaaggtttaaaatgttttcatataatctcactctaggtttctcaataattcttgtagatggaaaggccatgttgctgttcccatttttatggtcaaagaaatagagtacataacttgttagtggccaggctgggattcagagtcgatccaaacccattgttccttccccagtactcagttgcccagcacctgaactcccacatacagatccctggagacatcaccaccctgccctgccccctagcagtcagccatttgtgtagctgattgcatttgatatttcatttctcacagtttgttattatcttggcagttgggtttgcctgggtacctttgctgaaagatggtagaatcatcacatttgagcagcagctgccagtttccgccaatcttcccccaggctacttgaatctgaatgatgcagaatcaagaagggtaggaaaatactgcatttgttgaagtaatcatgattaaatgtgcaaaaaatagaattctgttggtctcgattgtttagtacaatgttactcaaagtggggtctgagggctggtgcgggtccacaacaaagataaacatggaatgtgcatgtttagaatttatagcagtttgacaaagtaattttatgtctgttgattttaataatttttttagtggggctcagattttgtgcataattttaaaaaattatttaagtaattcattttatcataatttataaaaatagtctgcaaaggattggaaatgtaaaatgatttatgatacatttattctaaaggcagggtattttctccagtaatctcttggtatgaaattaatacattcatttctgaaaaaaatgtttaaatgcataaaggtattatatgttattcatctatccattattatgttatagaatctcaattttctgttcacagcaatgtaacgtggatattaaatgggtagatggtgcaaagcctttgttgaagattaaaagccacttagaatctaccatttacactcaagtaagttgcatcatttgaattttgtcaatttttatacttgagtttgtttgattaaaatagaccacatttgattcctacagccttagagaatatgtgacctgcaagattttctcattagtaataacatctgtccaggtgcagtggctcatgcctgtaatctcagtactttgggaggctaaggcaggaggattgcttgagctcaggagttcaaagctgcagtgaactatgattgcgccactgcactcttgcctggaagacagagtaagaccctgtctcttaaaaaaaaaaaaaaacagtcattctatctcaaatattataattcctctcaaattacatgatcttttaattctcattaactgatttgagcctcacagaactctgaaaggaatgtggaagccatcatctccattttataggtgaggaaactgaggctcaggcaggttaggtgacttacccaaggtcacagagtagtaatcaggggaatcaggtcaaaacacacatttcattattctggttcctgatgtagtccatgctgtctacagaatcagtgtatatgggttccacataggacagttggactcccttgccagtgaagtgccatggtaaatttgggtactgaatgcctgagactattgttctgctaacttcctgctgctatcttttctttatcagttcacatctttattatttatttatctgtatctttttcagttcatacctttattcctgcttatttcattaaaatggagaagcagcccaacttcatagaacacactagtcaaagtcggaatcaaatgaatctttagctagttgggcataaatggtggcctaccccatgtgcttgtgtacatggcagatttacctggttttgctgctttgtatagtggtcaagagctgctgagcctgggcattagaataccggataaataggtctgcaagatacaggaggagggagaggtagagagcttgcatttgaggataatgaatcaaatttcatatggctgtttccatctgtgttccaggatctgcatgtgcacaaattcttccatcattgccagctgattcagtcaggctcgaaagaagttccaggggagctcattaaatatttaaaggtaaatgaacagcagctttctgcaaaacgtttgtttttcatgtctttctgttgccacattttggtgtgaaaaaaaaaagcaaacagacagtttaaaatatttttggctgtatttcctcaagagaatactttctatgatgtatttttccatcatgtggctgtttagaagcagacagcagagtggcaacattaggaagaaaatgtaatagccacaatgcagcatcatatttttgaaactctcatgaaaatgtttatttcaggtccataaattgatttttcaggggctttctcttcctgctgactgcccaataaaggtggaggatgctgtgggggaaagggccaggaggaatggaatcactttgacttggaatgaaatgtgaaattgttcttgtgtccatgggtgatagactaacaaaggggctagctaatgaaagacacatattttatgcatgttggcatattgtatcttaccacatgtatagaggacctaacacttggttttttccctgtgtgctaggactacagtgcatatcataatttgcctgacagtggctctcttcttttaattgttcctttagtaagatagctatagcaagtctgaggaaatattattttaaatgaaacatctttaggatttacctttggacatatgctattacttaatgatatactcaggaaacaaaaatgttcatttctttcagagaggtagtatgagatgagatcaaatatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaagaaaaaagaaaaagattagggcatctgccggatagtaatcgttcatgccacacttatttctttagtgcttcctatgggccaggcatcattctaagcattggaaatttaagtggagaaaacaaataatatccctattgtcaaagagcttacttgttgagacagacaataaacacataagttaataaatatatacgtcatctcatatggtaataactgttataaagaaaaccagcacaatgaaggggagcagggatttacaaggggtccctgttttaaagtggccagagaaaatctctctagtaaaggcacatttgagcagagacctaaaggaaatgagagtgccagccatgtggatttctcggggagagctgggaacagcaagtacaaaggccccgaggagcttggcttggtgtgtttggggaacagcaagaatcccagtgtggctgggacacagagtgataggacattaccttggggaggttgctgggagcttgtcgagtaaggcttcataagccatggcgaggagtttgaatttactccgagtgagataggaatatggagctttggacagaagtgtgacatgatgtgactttggtttttaaagtgtcattctgcttaccatatagaaaacacactgttggaagagtagaagggagacagtcaataagtggtggctatatggctatatgttcttaactatcattaagacgtataataggccaggtgcaatggctcatgcctgtaatcccagcaccttgggaggcccaggcaggcagattgcttgagcccaggagttcgagaccagcctgatcaacatggtgaaacccatctctataaaaaaatacaaaaattagccgggcatagtggcacacacctgtaatctcagctacttaggaggctgaggtgggaggatcgtttgagcctgggaggttgagtctccagtaaactgtgatcatgccactgtactccagcctgggccacagcgagaccctgtctcaaaaaaaaaaaaaaaagaaaaaagtatgataatcatctaacttttaaatcctttcctcaggtaaatatctaggacttcaatatgtatgaatgctttgttaaggtttgttcttcacatgggaaagttttataaaagtttcaatcaagtggaatggaaaagaacatcattttcatatatacgggtattcttaaaatagaaaagttctcgtatttgtttttctgaagatgtggaatttctggtatttatgtgacctacgctctccctctagtggtagtcaatgaaataccatgtgatttcagaaatagccaagctcctctatataaccttagtgctgaaaaggattcttaagactttttttctttctttctttttttgagacagggtctcactctgtcgcccaggctggagtgcagtggcgtaatctcagctcactgcaacctccgcctcctgggttaaagtaattctcctgcctcagcctcccgagtagctgggactacaggcgcccgccaccatgcccagctaattttttttttttttttgtattttttagtagagatggggttttgccatgttggccaggctggtcttgaactcctcacctcaggtgatccgcccacctgggcctcctaaagtgctggcattacaggtgtgagccaccatgcccggccaagacttttttttttttttttttttttaacagatgaggaagctggggcccaagtagaggtgacttgcctgtagacattcaactggttagtagcagaactggggtgagactatgacaagtcccatgttctttctaccacaccttgctatctcttgttcctataaatgacattgtttcaagaattcatttaccatccacttgttgagctcttgttatatatttagtattttcctagctctttgaggcttacagagaagaataatttagggttattgtccataggggaacttacagtctaactgaagagacaggacatacataagttaaatgacagtctgtcaataatacaattaatagttcaaagcaatatatgattaaatgtccagtatgtgatacagggcacaagtgctgagggttcggtgaactgaggaactactgtagactagagggctcctgtctttttttttttggagacagagtctcactctgttgcccaggctggagtgcaatggtatgaactcagctcactgcaacctctgcctcccgggttcaagctattctcctgcctcagcctcccaagtagctgggattacaggcatgcaccaatatgcctggctaatttttgtatttttagtagagacagggtttcaccatgttggccaggctggtctcgaactcctgagttcaagtaatccgcctacctcagcctcccaaagtgctgggattacaggtgtgagctgccgcgcccggcctactttcttattttattcatttattcagtaagtcaccaaatatttattgaccatgtagtatgggccagacattgttctggatgctatgaatcaaatggggaacagtttagacagcataccttttctagttgtggtagagagattataagtgagtgccatgaagaaaagagcaggttaatgagatccaacatgaccaggagtgtattctacatagagttgtcagggaaggcctattgggggaaatagcatttcaagctgaaaggatgagaggaagacaaccttagggggtaaagtcgtgtaaaaggataacagaatatcacagtaggtgtaaacaccttacatcagcatgtttgaaggacagaaaaataaaagaccgtgtagctatagtacagtgtgcattgtgaggggaggatggcaagtgacaggtttggcgggacaggccgggtatgtcgtaggcatggaagcttatgatagctctttgttcgtggtagtttgttttgttttgttttgttttttaacaacagaaagatggcaatgtctaatttgcatttcagaaagaacactctggctgtcatgttgagaataaattacagaggactgctactggtagcagggaatgcccatctctcttttctacctggcactattctatttatcatttaccctttctcatctctgaggccttaccagacattccctacccacttgcacactcagttgcttctttgtgcattttgtatattccatgatcatgctatttactgttgatattgcaattatttagttccatgtgtttatcccctgtacactgtgaactacttgatggtagaaaccatggcctttatttgtttgggtttacttttgtttttggtgtgcttggctattggaagttcatttgtttgccctttgtcgaatgagaaaatgaatggtttcactgaagtggggatttgtacttgccttgaaagagtagccaggatttggctaaaaacgatgaacagacacaaaggcaggaaagtatatgatatattcaagaacagtgaagaaaccagagataccagtttggccttgtagagaacagtgatgattgtttaggctgaaaatgtcagttaggtctgaaataacttggtcttgatactctacgccaggatttctcaatcttcgcactattgacattttgaggtagagttattctttgtccgtgagggtctgtgtgtgcgtcgtaggatatttagcagcattgctggcctctgaccactagatgtcagtatcactccctggttgtgaccaccaaaactgtttccagacattgccaaatctgtcgggaacaaaatggcccctggttgagaaccactgccataggctatggggagacatcgaaaaaatcttggcaggaggtggtctaatgtaacgagtatttgaggaagattaatttagaaatgagagttggatgtatggagagtaaagagaaattgtacagagacctgctaaaaagaaaatgatttatactattttggttattgattagagggtcttgaagacagatagtggcaaaagtcagggaatctgggaaagagaatttatgagttttttaagtacagagacttgatttatccacctctctatttcccctagcactacacattgaattgatatagaaagatgctcagcgaggtttgtttccttttttttttttttttttttttttttttggttagctggttgagtgagtgaatgatgtggagagaagggaagaaagaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaacatacagaatgcctgggggttagtagatgcatctccagtatcatctccaaacatctgttcctccccactgccccaggcaattgagtgttggtttaccaggagtcagttgtcaattttctaaaaactgtttatccaaattatacttattagctttagtaaagtgtttaatgttaaataacaaaatctgagtgccaaatagaggtgtggattaagtaattaacaaaaaagccccctatccaatggaaagctcacttttaattgagcttatatgctagtcaatgtatttctcactacttaatttttttgctgtttcacatttgcaaattttatcatatttctgtttgttttcataactaataatgacttaattttagtgtttgcatgccatggagatccaagtcatgatacagtttctacctgtaattcttatgcaactcttccgagttctcacaaatatgacccatgaagatgacgttcctatcaactgcaccatgtgagttttggtgttataatacaaagatgctatttatttgagatctttcttattttttaatggaggtattcattactataaacttccctcttagaactgctgttgcattccataggttttggtatgttgtgttttcattgtcatttgtctcaagatattttaaattttcccttttcttttttgactcaggaacatgtttaatttccacctattttgaattttccacggtttctcctgtgattgatttctagtttcattccattgtggttggaaacaacacttgatatgatttcagtcttcttataattcttagggcttgttgtgtggcctaacatatatggtctattctggagactattctatgtgctcatgaaaagaatggatattctgttgctgttggatggaatgttctgtatatgtctgttaggtctatttggtctaagtgtagttcaagtccaatgtttccttattacttttctgtctggttgatctgtccattgttgaaagtggggtattgaagtcctctatttttctattgcaatatatttctcctttcatgttcgttaatatttgctttatgtatttaagaagataaatatataagttccaattgaactttttccaattatgtaaatgttctgcacttgtgttgttcaatatagcagccaccagcca[133 bp omitted]gttcaagcgattcttctgcctcagcttcccgagtagctgggattacaggcgcccaccaccatgcccggttaattttgtatttttagtagagatggggtttcaccatgttggtcgggctggtctcaaactcctgatctcaggcgatccatccgcctcggcctcccagtgctgggattacaggcgtgagccaccgcttcctgcaggaactgaatttttaattgtgtgtaattttaattttaatcaatttaaatagacacaggtgactagggatgcatatttaacagaatgtggccccaagccatcaatttttacttgaaagaataaggaagtattatttttatgtgaaaacaaacaaggatatattgtagagtagaatgcaaaatgcacctgaattttgaaatcaaaacagggtacttaaattgtgggctgagtgctggaagtttctggctttggctttgctgcctctgctgttgccacaacctcttccagcaggcctcacaccacagccacacaccatttgcgggcatcgctgctgttggggatagtgttgttgaaaatggaagaaactttaggccagtggtttccaaaacatggttcccataccagtagcatcaatatcgcctgggaacttagtaaaattgttaatcattgagcttcactccagacctacaaaatcagaaattccgggagaggggctgagcaatctattaaaagggcccaccaggtgcttctgatatatgctaaactttgaggacactgctagtctcttacccccaattatagttcatatcattacacctgccccggctctcccttccttttccccgttgacatgcttttcattgcgtctttattcctttcctttccttctcctttcctttccctttcctttccttttccttttcctttcctttccttttccctttcccttttcttttcctttccttcttttttttttttttttttttttaggtggagtctagctctgttgcccaggctggagtgcagtggtgcaatcttggctcactgcaacctctgcctcctggggttcaagcaattctcctgcctcagcctcccgagtagctgggattacaggcgcccaccaccacacccagctaatttttgtatttttagtagagacagggtttcactgtgttggaaaggctggtctcgaactcctgacctcatgatccacctgccttgg[141 bp omitted]ctcctgggttcacgccattctcctgcctcagcctcccgagtagctgggactacaggcccccgccaccgcgcctggctaattttttgtattttttggtagagacggggtttcactgtggtctcaatcttgtgccctcgtgatccacccgccttggcctcccaaagtgctgggattcagccttcattttatctttctattctcttccttttattctcactagaggagatctcaatatttacctaatttgaagtcttttactggatagtagctaccaccatgcttcagacacatacagagatttagaaacagatgtgacatctgggttgtcaaattaaatatccttcttttgaactaggaaatatatttcataaggcccaagcatgttagatgctgaaatctttgttatgcctaaactatcaccattatatctaatgcaatcatctcacttttaattattcaggcagtgttagatgttttgggggctagacatgacgatcttaagaatcaaaatatgttaattcattatagcatgacatgctgactcttgtgaatgtcgtttcagggttctcttacatattgtatcaaagtgccatgaagaaggcttggatagttatctaagatcattcataaaggtttgtggagtaaagtttctttctgagcaatttgttttatgtgacaattttgtcttacagttcatttttttttgtttgtttatttgtagtatagcttccgacctgaaaaaccgagtgctcctcaggcccagctgatacatgaaaccctggctactacgatgatagcaatattgaaacagtctgcagattttttatcaataaacaaattgctaaaggtatgaacacaggacacaacaaggaacaaaagcagccatagacacactttttttgataccctcccgtttcacttctagtctttcatcagtttcacatgtgacccgtcctttctccaccattttgcccatgcatccttttcctgaagttctccacagaaccttcttcaccccaactacccaccccctgccctcatttaaatgtgtaaaagaaagaattttggatcagatagacctgagttagaatcctgtatccatcacaaaatagttttgtgacctggggccaggtatttaacatttctgagcctccaagtcctcatttctaaaatacaagtaaagcatttaacacatcgttcctggcacattgtaggcactcaagaaatgatagctcttattattgtcattatttttattacttcttttattaatggtagaatttcgagtatcttggagtatatctgattggggcttctctctactcttcaaattacatgaggtaggcaaacatctaggctacttaggctgcacgaatgtcacatcaagagcagggttggggtccaagctaagtgcaggtggtaataagattcattgtctatagagcatttaaaagcggtaacaagataaactagaagttagtttgctcttattaccacttgagggcaattagaaacaattttggggataaaatactccccagtgggacaaaggttcccatccttcctttatatattaccagtcaaccctgaagtacaatagtacctttttgctaaaaccatttgcagatattctgtgactttgatagtgacttgggatcacttgaaaatgttagtaaaattcaaagacaagacccatattgatctgtcaaactttgctaagcttcagagatttggtaaccgttaaagattctctttctttttttttcagtactcatggtttttctttgaaataattgcaaagtcaatggccacatacttgttggaagagaataagattaaggtaagtaaattaaggtaaagaataactttcaattggcaaatgataattgtatatataagaataatatttgatggagacaaaaaaagctaatcttactctcagatagccatgccatgcaaatcccattttatatttaaaggctgctagtgcttggctttttcaatgttgcttacaaaacaatggatctattgcataaatctgaggtctcgcagttgatatgttctcaccgtctaatctgcagagacttttccacatagattctttcctataatcatttgccatgtacatctcattacctttgaagctttgcctttgtcttatggcttaaaaatgtctctcgagaagacccatttggttaaatcagacatagcgcttgcccatgcacgtggagtgttacaaacactttatgcactagatatgatcccggaatgtgatgtatacattttgttgtaatttttaattgtttgaaaggtataaaaatattttcttattcataggaatcataaagctaagacttgtgaagtacaaaatatttaccttatacttaattattttttatcagaattttcacagaatatgtttactgaaattgaagtgcatgcatactttgtgtgccaggaaaaaagtagaatgaaaactgcgttgtgtctgtaactcagaagcatgatattccaaagttggggcagaacaacccattcttgctgataacctcagtcaggtagattattagagatccagatagttcctgtaattatatagagtgaagtacatcttgaactagtgatgtcatttttaagttgggagaacaattatacatcagttttaagatatatttatttgtagaatgtgtttgaaagtaaaaatggcaattgatttagaccttttggaagtctgacttttttctgtgcctatttcatttcagcttccccgaggccagagatttcccgagacatatcatcatgtcttacattcactgcttcttgcaataattccccatgtgactattcggtatgcggagattcccgatgagtccagaaatgtgaactatagtttggctagcttcctgaaggtgagttcaaggcagctagaatgtggtaaggaactcctcttcattgataggaagcccaagaaaaaaattaagcactttctagaggctcagctaggtcttcataagactgttggaaaacttaggttgcttacaaacgttggctattgtgaacagtgctgcaacaaacatgggagtgtagatatctctttgatgcactgattttcttccttttgggtatacatctaagagtagaatgttggatcgtatggtagctctattttcagttatttgagaaacctccatagaagacattggcattggcttgtgttc[131 bp omitted]tgaaaccccgtctctaccaaaaatacaaaaatcagctgggtgtggtggcaggcacctgtaatcccagctacttgggaggctgaggcaggagaatcccttgaacctgggaggtggaggtttcagtgagccgaaatcacaccactgcactccagcctgggcaatagagtaagactccatctcaaaacaaaacaagaaaagatgtgagaagctaccttagtagtcaaatttaactatatatacaagataaaggtgataacaataataccagaaatacaaacaaatctgttcttgatagtgattgtactaatttacattctcaccaatagggaaggaaggttcccttttctccacatcctcaccaacacttgttattgcctcttttggataaaagctgtatattttagcttacctgatcacaacaaatttgtccccatcccccaatgaaatgacaaataattaaatcagaggacacatacaggtggcctagtcagaagacaagtgttgcttgttgtacacagtgtttttaagcatagtttgaatgcttatttaaatgggagcacatactttctaggttgccaccatccctaccactccttattacagccctgagcctcctcattcatttaaatcgtttctctgaccccgttggcttttgactttgcaacttttggactaaagcaacctgtttggtgatgtaaccacagtgtacatgttgctaatacgtgtaaatgtaaattgttagtgttgatcagtgaggttattttatttgggatataccagaagaaaactatatttatgaaagatggcaaactaccatcattaggttttgttattgtcagtatgtaagtggcagtgagagaatgtaactgttttttctttcttttttcttgctttctttcatttttttttaatttgagacagagtctcgctctgtcacccaggctggagtgcactggtgcgatctcagctcactgcaacctccgcctcttgggttcaactgattctcatgtctcagcctcccaagtagctgggattacaggcatgcatcaccatgcccagtatttttagtagagacaggggtttgccatgttggcctggctggtcttgaactcctgacttcaagtgatctgcccctcttggcctgaatgtaactgtgataaagtgggtaacaacaatatttgatgtgtggcagagacaagcgtgggttgcaaatgcacctagtttttacttgcctctttccattctccctctcttcatttctcaaagctcttcattactctcaaaactcttcatattaagaaccttgtgggcagcaattcatccaaggagttttagtttctaacatatcctcattgttaattaaaaattcacaactaggtttcacacatcttgagtatgattttctgacataagacttctctttgccagaattaaaataaagttttaaccctattacactagccttttttgtgtattaaaaaagccaacatccacatatctttttaaaataaactacgaattagattatctgaaatgtagaatattagcttcttccatggagtttaaagttgaagtttactatgtaaagggaatagaacatttttggtttagtagcagtatttacttaattcaagtcagcaaacattggcttgacttctgtgtggcaattcaaagatgtgagaggccgtgttagtagtcaaatttgaatatatatacaagataaaggtgataacagtaataccagaaatacagacaaaatactatagaaaaactagaaagggagagagagattatgaccaggcagcatgaaacaagtaacatagtgcagagttccccaagacaagagttgagcatgttgcagttagagggtccctgaacaaagatgaaatatgcatgttcaaaaattgttcagggacgagtgaaaagtcgtgtgatgagtttaggatgtatggagaaagagctggaaaggccatctggtgccaataatgaaaggccttgaatgtcaggttaaggaatttggactttgattcatatgcaatggagtaacaccaaatacttgggaggatacttttcttgctggtatgatagatgaagtgaggaagagactcgagtcagggcaaccgattagaaaaccaatcatccgcgtggcacaatccacttatcttttaggctcagctcttccctggcctttccatgcagtgttgatcaccccttctgttgttcacctgtcttttacatagctctgtggcactgttattgtgcactatcttttcattatttgtttgtcttcactattagacatgattatggaccatgccttattccactttgtatttctctagaatgtagtacattgtctcaaacatagtagatcctctaaatgtttgttggatgctggaataaataaatatgagcctcactcagtaatccagatgagaggtgatgagggtcttaccctgggcagtggcagcagaagtataaaggagagtatgagatgcaagatgcaggtagctggttaatcaaatattgaattcttcggatttcacagaaatattctaggcactatgaaggatataaaggaaaagatcattcttattgtccaatctaggtgagacgacaggaaaacagtcagtaaaatacaagctaatactgaaataaagtgtttaaaaggatccatggaccaatgtagttaaggaagatgggatttcatgagaaccttaaagaatgaataagaccagatagaagtagcgaaagaattgctaggtgtggcataagccaaagacttagaggtgggaatacacagtgcatctcgaggggataataagtgaatgatggctgagcatgctggtgcccgccttagtctcagctacttgggagacaggcaggaggattgtttaaggctgtagtgcgctatgactgtgctaccacactccagcctgagtgacagagcaagactctgcctgtctctctctctctctctttttttctgttttgagacagagtcaaagaaagtcaatgagatctattggcaaatgaagctggacaagtaagttgggaaaagactatgagtgttcttgaatggcaagctaaggaatttgaaattgtattagagacaatagggaactattggaagctttggggcaggaaaatgacaccattgggctaggacttagaggttaatctggaagcagatggatagagacatgagagacatgaagactgaggaggttaactgcagtttttcagttgcaaggtagtgagagccttaactaggacaatgacagtgggcaaatataaataacttggggctgtcacagagaagggaggttttatgctttgacttcactgaacacaaaaactcttttggtctgaattattaatatttacataggcaagcctcactttcatcagctaacagactaccttacacttccctttggaagtgggagttgaccaaaatgaggtcaactcgcttgggctttgagagttgaccaaaatgaggaagtgtagctgaatagattacagatatgtatgtgtgtctgtgtatgtatgtgtgtgtatgtatagataaatgtatatttgtgtgtgtggctatatatacatcttgttctgaaaactgtataattgaggcccttcagtcccaattccagtgatgccacttgccctttatctttttctttaaggtcacctgaagctcagaaagttatctataaaaataaaaatgtctttctttttgtgtggaaccaattttgaatttttaaaactttacatttttaaaatttagacttttagaattatgtaattaacccttagttttgttttggtttctatagcgctgtttgacactaatggatagaggatttattttcaatttaataaatgactatatatctggattcagccccaaagatcctaaggtaagttataaggacatgattgtagtggatgtcagacatctgagcataagaccaaagtgacatttattctcttctaggggattaggaactgttgtttttatttaggtagttggactatagacatacgtaaaagcaaggaatactggactgtgttttggggtccccaggaccccccatgtgttcaatagctcattttaaggattcacagactcaacatatagttgtattgatggctgagattcatgagcgtgacataatgaggatactcagctgaatcgggaaaggaaaagacatcaaatggggtgggtagcaatccacatgcagcctttttgagctctttccctcctgtgaagggtctcacagagcacagcctccttctagcagtgaaaatgcacttgtaagtgtgcaatatttctgttcaaggaagcctgtttaaaactcagagttgagagtttttattgggggctgattatgtgttggaggctggtcaaaattccagactctcagaaaggaaagcaaagcaggtgttcactataaatcacaatgtttgtacaaatagtctaagcaggctgacacagaaggtgcaacttaacatgtagggaacatttcaaaatttcattttttagatgccagccaacaagcaggccttttaaaggatagcagtcttggacctgctatgttaactctttcctgcacaggtcgcatctcaaggtatgcttagaatactaagcacttccgttgtgaaaaataatgcgctgtattaaattcttaaaatagcaaatgcctactaaatatgagctaatgtatcatttctttccatttaggttctggctgaatacaagtttgaatttctgcaaacaatttgcaatcacgaacattacattcctctgaacttgccaatggcatttgcaaaacctaaactgcagcgggttcaaggcatgtatttgcattttccatcatttgagtttgtttttttccatgttttgctagcgctagtgtagtataatgttttctagttgaaccagtcaacttgaaggtaatttcagaattgttactatctgaagtccattaatgtttttctgcatttccttcataatatcagtaataatgttcatagtgtgaagaaatcaggtgtgttaatagattgctgcttaaacacagatgtcagatactagtgaaattactttctgtagtagtgtttgggatcttgtatgagactaaattaagaaaaagacatataaatgcatttctcctcaaagcatcaaaaaatgtaaaggtagagtaaaatggtaacatgtttgtgctaaatttatgaaatgccttcagttatctccattgctagttttattgaatgctttgttgtatagcactattcttatgttactatgttttttatttgtcccttttcttttcatatattaattagattttttttcatttgcggtggaccgtttgacttcagtaggtaggtttaactcggttcactctaaattagcttgctgttttagaaaacaattgatttgatgaattgctaagatggatgggggctttgtttgcttttcaaattctccctagccaaaatgaggctttagttaaagtacccagaaaatctaggaggcagtgtgtttgtttagttttaaaataaaactgagtgttgctagagaaatcaactttaaaacattttccctcaaaacacaagttcctgctgcaagccagcatagaggccatggatggggaactggaagttacttgttttttttttgtttttgtttttgttttttttttgtgtgtgtctcctctctcaggcttgcctctctcagatgctgtttagtgacaccttggccacaattttgcaggtgtagatgaaaccacctgattggatttattcaaatcaccaaaataacaaattgattaccatttgtaaaatctactcagataaagccacctttgttagtcagtcctggcccttgtgcatagaaggtgatagggattcacaaaagagcaagaccaatgcaggaagaaaataatctgccttggtctgtatagaagtatctgctgagtggtggttttagtgatggaattatagccagtgaaaatggagaaaaaaatatttttaaaccatagcactcctattcagctacccccttattcgattctgaacatgtatagctcacataattcacccaatatttatttataactatgaggaagtcaggaaaaagaagaggtggacagataatcaggatttaggattaaattggactactcgcagcatttattaagtcccaactgaatataaagcattgtattaagtgctgaacaggccaaaagaaaaatagaaaacataatccttcggcttcatggcctatctaattaaatagcacgggagaggaaataaagatagta[139 bp omitted]ctctactaaaaatacaaaaaaattagccgggcatggtggcacatgcctgtaatcccaactactcaggaggctgaggcagcagaattgcttgaacccggga[134 bp omitted]accatgatattaacatctgggatttaaaatagactgaggatctagcctgggcacagtggcttatgccttaatcccagcacttcgggaggccaaggcaggcagatcacctgagctcgggagttcgagaccatcctggccaacatggtgaaaccccgtccctactaaaaatacaaaaagaattagttgggcatggtggtgcacgtctatagtcatagctacttcagaggctgaggcaggagaactgcttgaaccctggaggcagaggttgcagtgagctgagattgtgccactgagctccagcctgggcaacagagtgagactccatctcaaataaataaataaataaaatagactgaggatcttaaaggaagggaaagacttagttcgaagtgattattttctgatataaaatatttgtttttgagtgatgatggattggaatgaaatgagactgttttccttattgttcttatgtcccatgtatattttcagcccaatatataatatttactaaaacagtcaatactgtcagactattcagttgtttagtttgtcttttcccactttataagtataaatggataagtaaatcaagtattattacatagaatttttcaaatttatagttgtgacaaaatctcttcagctataaagaaatctgttaaaacgttgcaaaatatataattattttattgtagtttctatcctaagatttctatgagtttaaaagaatctaggggaaaaaaaagaattagggactttctttctgactgaaatgatcattaaagctatcgtttagcccaaaatatgagtgctcctgtcttgtaaattttgcatgcttattctagatgataaaagaattgctcagaatcattaataataaaaattatagctcttgctagcatgatcacatattattaaataatacagtattttaattataatcatgttttgaatattttcataaatgggttttaaatttcattgtactgcagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaaggtaaggatatccatgcagtcatcagtatcacactggtagagttctactatgattttttatagaagatgaagtttttgtagcaaggagcattatataagcattgaggaaaatttatttttgcttcaaatcataagttgttttttttttgagacagagtttcactctgccacccaggctggagtgcagtggcatgatctcggctcactgcaacctctgcctcccaggttcaagcgattcttgtgcctcagcctcccgagttgctgggactacaggcgagtgccaccacgcctggctaatttttgtattttttagtagagatggggtttcaccatattgtccagactggtctcgaactcctggcctcaagtgatccacccactgtggtctcccaaactgctggaattacaggcatgagccactgtacctggcctcaaaacattaggtttttaaaaataccatttgggaccgggagcagtggctcacacctgtaatcccagcactttgggaggctgaggtgggtggatcgcttgaggccaggagtttgagaccagcctgggcaacatggtgaaacctcatctctactaaaaatacaaaaattagccgggcgtggtggcacacacctgtagtcttagttactcgggaggctgaggcaggagaatcacttgaactggggaggcaggaggtggaggctgcagtgagctgagatcatgccactgcactccagcctgggcgacagagtgaaactctgtctcaaaaaaaaaaaaaaaaaatatatatatatatatagtttagttaactgttaaagaaatacactgttttctcaactcatacttaaagaataacataactgcttcatgattaagaatttttaaaaaatttattctgtgaaacatatgctttaatatatctttaaatatatatcatatgtaaaatatgtaataagtttttcttcttactgaaaaaaatgttaatgtgatggtgttactataaatagctgtgggtgtggctataaattttacatacgttacactgttgtctatgagtaacggtcacagctacagtttctatttactgcactaattttgttttctttctttttttttttttgagatggagtctcgctctgccacccaggctggagtgcagtggtgcgatctcggctcactgcaacctctgcctccctggttcaagcaattctcctgcctcagcctcccaagtagctgggactacaggcacacaccgtcatgcccagctaatttttgtatttttagtagagatggggtttcactata[135 bp omitted]acattaaatcctgttggcttgaaaaagtagagtgcaaactgtatggatttagaagactctaatttacttccacggtatcataaatcactctaggaaacataatattgtttcataataaataatttatccttttctttttacattccaatataaataaaattatgatgtcatttatcatcggtcattttggaaggctgacttggagcttttattctttttctacggtattcccatttgtcctttttaaacagaaaatgcctgccagtgacatctgctcacattcctttaattacagtgattttcatacatgtaaatcttgctagttttcttcatgtgattgtatcctaaagtagatttaactcctttgctttaagatgtaatttattgcttactgcagtttgctttgtttttgacacattataacatacctccacttagtgtagttggctcagttatgtgccattttcactttttgtgaatgttgatattgacttcacacaaattaactggtataatatatccaaataaaaagatatcttaaaagtcctccagtccaatcaagcttggtcaagcctttaaaaatgcattatcgctgggttctggctaactacttgcttatgcctgtaagtggggaaaaggatcttatgccacgtggaggaaaatgtctttagccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattgaaatgccaagccttattactctttcaatgacttctgaagctctttcctctttgttcagaggcttcatacaggcattaaatgacgatagagttttctccataagaagtttgtttacttcgtgggcttggttaaccaaagtttcaattctagagtattggatgaggatataaaaggtcctttgtctgttttgtgcagtttccaggcagcctgtgtaagagttcatttatcaaatacatccaagtagagcatgtttcctattaatgatgacaccaaggtgagggattggagggagccttaagccctcatattttccatcagttctctaaagggaccccaaagtaataaaccaaaaaaagaaaagaatgtttcctatgaaaagcctgctttgagactcaactccctaatcatccccaccctttccagccaattgccactcctaagcccctgctcttaggaaattctggagatattgctggtccctgttatgtgttactcataaactatttagcaatatctctctcttttttttttgtgacggagtctcgctgtgtagcccagactggagtacagtggcacaatctcagctcgctgcagcctccgcctcccgggttcaagcagttctcctgcctcagcctcccgagtagctgggattacaggcacgcactgctatgcctggctaattttttgtatttttagcagagatgggatttcaccatgatggccaggatggtcttgatctcctgacctcgtgatctgcctgccttggcctcccaaagtgctgggattacaagtgcgagacaccgtgcccagccagcaatgtctcttgttataattaccatgagacatttttccttttcagaacaagaatgttcaatatctaacatttaccctggggcctgtatagttcttgtacccactacaagtaatgttcatacctaagagaactgcagattctacttctagttcggctgtgggcaaatcctttttccttttttgaaaaagtaatccacgtgcatggtgaaaaacaaaaatcaaaatgcctgtctcccattccttacctccacttaccaattcatctttccagaagcaactactcttgtgagtttatttatacttctattttatataagcacaagcctatatgacatatatgtataaaatataacagaaaccattatacatttttcttttttcacttaacaatacagcctgaaggttagatctaccgcattttaaaaagtagctgcatagtattctatcatatggatatactttattttatttatctaactagtcttctattaatagatacttaggttatattctctgttgtgcaggcaaaatttttaacatatttggcaatgactgtatgttttcctgtgttcctgcttccctgagagaattgtaatttctcttcccctagagatcactcattatcagaactaaaatggactcctatttagaagccataatattaataatagcagctaaaatttattgaggactcactatatgccgaacactattttaaatacctcacattaattgatatcattattattacccccattttaccaaagagaaaactgtagttaagtgacttgattgtaatcaagtagctagtaatgggagagctgggttttgcgcatgtctctaactgcaaaatctgtgctgtcagccactagctatactgccttttaaatctcaacttgggacattgaaaaattagagaaccaccagaaaaagggtaatcactaagtgaaaaatcttg[133 bp omitted]ggccaacatagtaaaacgctgtttctactaaaaagggacaaaaattagccaggcgtggtggtggatacctataatcccagctacttgggagactgaggcaggagaatctctcgaacccaggaggcagagattgcagtgagctgagattgtgcctctgcactccaacctgggtgacagagtaagactcagtctcaaaaaaaaaagaatgagttaagatgattcatggtaactgtattcacatatttaaagggttgccatgcaaaagtagaaatagacttattctttgtagctccaaagggcagagctatacctaggaggtagaacttaggaggagtgtatttcagataaaggaccttcctaatagaacccatgaaacggcttgagttttaaagaagtttaaaaaactatttgtcaaggatacatgtaagggccattcattcctgccttcagcaggaagttggactaggttagtggttctgaaacatttatgcacatcagcatcatctggaccagtccagacctggtaaatcagaatcttctggtggtagagactattactgacggggtactatgttggaagaaagtctgttaagaagggaagggtttttgaaattcacaaatgaagtgcaaatggccaattaacacgtgacaaattgttcaacctcaatagtaaatgcaaactaaaacaatagtaagagaccagtaatcttctacattctacatattgaccattttgccctagagggccttatctaattctccagaaaaacctcctaaagtcatgaaagatagagggcaatgcttgtgctaccacagccactattttctctgatttgagtgtatatacatatctggcgaggaatgtctataagctgaggaaagaaataaatttgtataagaggtaccacattaattaagagccctggtggccagttttatttacatatttacaaatatatcaatctcccaagtcttaaaattgacttaggggaccaagttcatattattgtaattgtagctttaatggaagcaaaaaatgtttcctgaatgaatacagtaacttaccattttttcacttcttccacttactcattcattccttcagctaatatgtattgaccatctgctatgtgcccaggcattggggatgaagcagtgaacaagacagacactgtccctgctctcatgaagctcaacgctcactggagctgaaaaacaggaataatatcatctgctttataggccaacttctattttttacaaaaaccttttacttcatgtcattatgtttgagggatgtaatttgagtctgtatcatggataaatccaaaggccaacaaagttctgtggtaattagttttcagactataagtataaagagattcatgcttcagtaatttgttatggatgttagcctactttttagtctttaaattgatatatgaagccaactccatttatttgtaatatatacatattatatacgtattaagctttcaataattatttttcagaaccaacaagccaaaatagcacaattgtacctcccctttgttggactacttttggaaaatatacagcgattagcaggtcgagataccttgtattcttgtgcagccatgcctaattctgtaagtagtaatgtgtttctgttggagttttatcctattttattgaatgcatttggaattggggtcatatgctatatgatctcaaccttaagagttcacttttttttttttttttttttttgagccagagtctcgctctatcacccaggctggagtgtagtggcacaatcatagttcactgtagtctcaaactcctgtgctcaagtgatcctcctgctttggcctcccgagtggctgggactacaggcatacgccaccatgcccagctaatgtttttcatttttagcagagacagggtctcactgtgcagcccaggctgatctcaaactcctgagctcaaggaatcctcccctctcagccccgtgaagtgctgggattacaggcatgagccaccgtgcccagccaagagttcagtttttactccatgtacactgtttttcctaatacagtgctt[157 bp omitted]gcctcagcctcctgaatagctgggactacaggtgcccgccaccatgcctggctaatttttttgtatatttagtagagacggtgtttcaccatgttagccaggctggtctggaacatctgacctcaggtgatctacccaccacggcccccaaagtgctaggattacaggcgtgaggcaccacacctagccaacagattttaattcaatagacctggggtgggacttgagagcatgcatttctaacaagcttttggctgcttctggtccaaagattgcactttggaaaacaaattccaagagaacaccacaaatcctttgaacgctgtgttttcgttcttaacattttctgttgttgtatggcttcatacatttattcaacttaaactgaacaaaagattctctacttccaagatattaggcactggggactaaactgtattcctttgcttctcctttcccttagtagtctccttcagcacttcttggtgagactcttttagtttatcacaattggtctgtgctttttttgctccccttagaattttaagaattagaaggaactttggaggtgatcagtctcctatttggcaaaacaaccttttgccattgtaataatttaaacattccttctcacattagacctaaaaggttttctatccactggtcttacttttgtcttctagagacacatgaaacacatctgttcccacctccaaatgtaccctttccacttgtgccttctaaatttttctccaagccaccaaatatctccactaatctgtcattccaaatcctttacttttttttttttttttttgagacagagtctaagtctgtcacccaggctaaagtgcagtggcatgatctcagctcactgcaatctctgcctcctgggttcaagtgattctcctgcctcagcctcctgagtagctgggactacaggcatgcgccaccacgcccggctaattttttttgtacttttagtagagacggggggtttcaccatgttggccaagctggtcttgaaatcctgacctcaagtgatctgcctgcctcagcctcccaaagtgctggaattataggcatgagccactgtgcccggtccccaaaaccctttgctttcgtggtcaccccttttccaaatatgcttcagtttaccagtaaccctattaaaatacaatgtccaaattatacactttatagtctgcccagtggactgttaacttctgcccccatccatgttctgtatggcccaagatcacctttgcactttggctggccacgtaatattgttgggtagcaggttaaactgtgtcatttacagcttcctctgcaaattccccctatgaaatgctacagccaatttgtcatgcctgtcctgtgttcctgaggacgttgcttttaagcttttctagtggcttgcttccctgtgactcccagtcatgtcaactggctgaatgtggatactacacctacctgagtgtcaggctggtctcactttacaaatacagtatctcatgcttatgctccctccacatagatttgacagcattatttggaaatatttcacttctctgtattctttgcagctcaagtttccctagggcttctggtcacacaccttcttctagcattgccctggttctaaggaggagaactgaatcatgttaagactttaccaggctgggcgccgtggcacatgcctgtaatcccagcacttggggaggccaaggcaggaggatcacttgagtccaggagtttgagaccaacctaggcaacatgggaaaaccccatctctaaaaaaatgaaaaattagctgggtgtggtggtgtatacctgtagtcctggctaatctggaggctgaagtgagagggtcacttgagcccaggaggttgaggctacagtgagctatgatcatgccaccgcactctagcctggactacacagcaagaccctgtctcagaaaacgaaaacaaaaaagactgtaccagttgcagctgtaccagttgcagctatctagaattatgtcacttggctagaggtcatggttacaacagtatgctagtagctttttttttttaaaaaagagtcacctaaatactaattactagtatctgatttagactttcacagtgagctttgtttaaaatcaatgtaacattttattctgttaattcagatttcttatcctatatacgaatttgtttaaatgacacaggtatcatattctgttacaggcatccagagatgagtttccatgtggctttacttcacctgccaatagagggagtctgagcactgacaaagacaccggtaattaaaccttttggagatgatacattgcgtgggtgtttagacatgtaccctctacttctcagtatttttgatatatttcataataaagaccatacatagcttgatctctactaaagtttaattaaaatctgacttatacttgcagtcaaatttatttgcctaggtttccttgtctaagcttatttagaacatagcttggcatactgagaaaatagaggataatgagaaaaatactggtttccactcttcttatctgtcaccagttttaagccagatactcccatctatgggctcaagtttccttgtctataaaattgtcttttaaattgtgtggctttattttacggcttccaaggaatttcttgtcattttgtacatgctaaagtgttttgaaaggtgaaaagttgcttcacttttacatggtttcttatggtgttttgatataataaacttcacattttagatgtccaagatctattccctacattaatgtctctacttaaattagttccgtactttttaaatatttctgacagttccccctcttgccaacaagggcttgacttttttttttccccagcttatgggtcttttcaaaatggacatggaattaagagagaagattcaagaggttccctcatcccagaaggagcaacaggatttccagatcagggcaacactggtgaaaatgtaagaacttaaatatataggatgaccctagtgacacattagcctgcaacaatttttttatagtataaatatgagcatctgtactcacctgtagtccatcctggctctgcgaaaagcatcccataattcttagatattttagcagtatcttcctatagtggcagctgctacttcaatgtcttaaactatttatagagaataaggcattcatcctcaagagttctaactctgaatatctcctttaaccctagcacgctattttagtgaggagaaattcaagtttaaaatatctaatgtgccttgttatttaaaacgaagcacatcctggcaggattaatgcagtctttcattcttttgtaatagagtaatgatattaatttgggaggaaaaaatataggtcccaaaattgacaatcttagggtcccagcatcacttaatcagaatatatcctcccaactcttctatcaagtcgtttcacgcctaccattaaagtttgagatgtgactgccttaaggcagaaagacctcattttagacgagtaaagttttgccatgttgttatgtaaaatcattgaatcgtataaaattatattagaagggactataagaacaataaattccaactctcaatttacaaatgaaaattgggattatgacttagaacaaccagctatggcaggaccatactcgaacccagattttctaatatgagcactttgtctcctatatcatggtgctcttagtgtacatcagcatcacctggagggcttaaaaaatagatgtctgggcctcaccccagggtgagattcagtaagtctggaatagggcctgctaacatgtatttctaagttcccaggtgatgttgatgctgctggttgggtattgttacccttgagaaccagtggactatacttccactggttccttgagcctttgggtaaacagtaatttattcacaaatgtttctcttttacaccatttagaaattgtgacaacaggtactgtcatagctaaggcaaataaaggtcagagaggttgaatgacttgctagtagtcacatagtagctaggcaagcaatcagaacctaggtctgtttgctccaagtaaaagttcttccttagtaaattccaccctagtcaatggtgcatccccagtttagctcaactgaaagtattagtttttaaattttttagattattgttattctattcatataaatccccaaataagtcagatcttgtcatgcttaatttctgatattttttaaaaagtcattaaataataggaacacatcagtactttgtagaggtactaattttgaagtattattgggtactcctaagtgtaattatcgtaatataattagcccattttttaatttatttatagtttttagaaatagggtcttgctctgtcacccaggctggagtgcagtgacacgatcagtgctcactgcagccttgaactcctgggctcaagcagtcttcctgcctcagcctcctgagtagctaggactacaggcatgcaccatcacacccagctaaattttttttttttttttttttgtagagacaggttttgctatattgcccaggctggtattaaactcctggcctcaagtgatcctcccacctgagcgtcccaaaacgctgggtctacaggtgtgggctactgcgcctggttttattagcccttaagatagattttctaatgtatgatttggaggttggattttaataaactctaaggaaagattcaaatgaaaaagtttaagatgtttcttatgctttcactccatgtaaaagctatctttccttaaatagccatgattattttaaaattttaccactaaaacacatggcatatgagaatgaaacacagtattcatggctatatctttgtgaagactccaaggtaatttctagtgatattactagctattactaggaaagaaagattcagcccattcaccttcaagttgtgatataaaatttagatttatgtttagaattttcccaaacagatctaatgataaaaaaagagttactgagttaaaggctgtggaaaattgtactgatactatttcacgaacatcctgtccttacagacccgacagagttctacaaggagtagtgtatcccagtataaccgcctggatcagtatgaaatcagaagcctcctgatgtgctacctgtatatagtaaaaatgatttcagaaggtgagttaccatcatattaagcatggactgtactagacatacaccctcacaggttcacaaattcatgcaacaatatttgatcatcatctggaggcagagcacatgcacattataaacagttatttggagactctgactttaaaatgtttcttaaattgaacttcaaaataggttcatgtcagtcacacaagttcgagtctttgaaataattttaacataattttgcaaatgaatttctaaaatgaggcaatggttttagaagtgctaaacattttgttttcatgcagagcatttaattcattaaatgaccaatgtaactgaaaggaaataataaccaccagaattcatatttaatacttcagcttttatttaacccaggatttgacaaataagaaacaaaaagacaggaagagttcttgaagggtagggaatgtcatcattatctttgcagcaacactgtatgatattgtctggtatcgcgttctttgtcgggctctgttttttctccttggtatagagccgtatttactagtgtcaccagttcctctttacactatatgatggaatacaaccgaaggactttcataaactgcatgtcctcgggaagtaaaagcaggttatttccaaataccacatttacttagacagttccctcccttctcttccttttcgcaatacttttgcttaaaaaaaaaaaatgcaaaaatggaaaacataaaagcacctgggatcatcatagtgattgctatcttttactcattttctatttttttatttttagtaattatttcgttttaaatattttataataatgcaggatgtaaagacataaaataagttgatatctaagtagctatagaaacattaaaataaatagctagatatgagtaaattctaaagttcattaataaaataaaaataactggaatattcaagttctaggaatgtacgatttagcataaatatcaaacattatgttgtggaatctggaaattgctaacatttatggagtttcttcttaaggcaatgaaaatgttctaaaactgtggtgaaggtttccttagtctttgaataaactataaactattgtaatattgtgggctatttatgtgggcatttttatgataaatgaatctctcagtaaatgtttttttttaaaaagaggcccaatctttatctgttctccactcccattgccacttgactagccttaaaaaaaataggtccaagagatacattagaaaaaaagcagaagtgaacaaaaaagcggttgaataccaccacagcccaaagaatgagggaaagagagagaaggtaggaggaggggaaaagctgcattgctgactagttctctcccctcctccactgtaggtctcacacacacatacacacacatatacatcacattctatactaaccagagacaagtctctggttgttatttttaatgtcatgggtaaaaccatgactgtttttgttttgaagatggagtctcactctgtcgcctaggctggagtgcagtggcaggatctcagctcactgcaacctccacctcccaggttcaagtgattctcctgtttcagcctcccgagtagctgggactacaggcgcccgcca[185 bp omitted]attcttgcaaatgttgaccatgcttgctcagtggcagtactctgtgccgaatattcagtctttgttaattaggttttgtagtcttctgctcttgctttttgattttaaaaagcacattttcaataactagtatacagtctatgtcacatctgtttatcttttatatgtataaagtcatgctgtatatctgtaaagtcatattcattttgttctaagaaatgtcttctagatccttctcaatggatgtattctaattactttgtcttgtccggtaaatattgttttagttactctatatgcatttaaatatttatctctttcaagtccacaatcttgaggtcctctcttggctttcttttttattgagtcataaacagtagcaactttaatgtcaatgaaaagatgttctatctctacacttttatatggattctggagaataaatttcattctctacttatagctgcattttattaattgacaaaaatttgctatttcaaagtcttagattcatttgccaaacattttcaggccttactgcttagtttattatatcgtgagaaaaggaataagagtcaggagttaccagttacgaagtctgaattgacaagaagactgttctgttggaaaagtaaaacattgttgcttccttaagagagaaggtggtggggggcggtgggggggggggtgaggggggtgggggggatggggaagctacttcctctttctttgtgactgtgtcttcacttttctctttagcccagactccaaaaagacactctcagtatcacattgaggcttatcggcaccataccctgcacttgtagattcattaatattctccgaagcagactgttcattggaaggtatctggttagagctatctctcactgcaaatttggtgttagaaggaatagcaaccactgctcttctttttgtactagattttaaagtagagtctaaaggcaagacattcaaagggattattttcttttcctttgcaagagggctatatgaggttatagaataatcctctaaagtttccagtaaactttcagatacatgagttgggtattctcctggggagatagcggaagggttccatgatgtgccaatctgagtttctttttgcggggagacctttgtttcaagtgtcccttttggctggccaatcttgtcttcatgaagattgaaaaaatcttgaaattcatacctcttttgaggactaagtgaagttgttaaaagagaacttgccagtggcttctggctggcagggtcttctatgttaggcttagtgtcattagaggaacttttcgcaaaagaggtctctggcacttcaaagaggccttgactaaaagatggagctggaaactctgaactttgttgcagttcctttgtgctcgtaggtttcatctgcttactttgtgactggcttatcgatttgataggcacatgcctctgccttccttgtgcaggctccctgactgaaaaatctgacatagtcatttgactaccagaaacgaagtcatcactaccagaagtctgaaattgttgttgcctcattattattttagaaagccttttattttcttctcgtaatttatttgtttctttagtgagttccgcaataaagaaaagattttgttgttggatttcataatagtctttctctagcgcaagcctgtatgtttctgtcattgaacagcagtcacaggtttttgcctttaactgatctttcaagtcattaatggtgctctgcaggactctctgctgtttagtcaactctttaattttggctgtggagcccgtccgcctcccgtctgacaatcgctgtttcctcagacttgttaattttgcctgtagacgccgcagctctttatcatggagctcttttagcgccagccatgtttttttaaaattgtcagattccaaatcacatacactaagccgtgatgattctcttcctgaagatttcttacaacctctcctccctcctacaccctcgttccctgcctgcatcatgtttcacagatttggaaatgggagggatggcctcgtcgctcaacaacagtgccgttaagaaaatggcggacttgcagtggattggagctagttcgctgtgagggcgagcacttttacccctttcacagaccttctccgaagctaccttaggacatggggcgagggagatgggtgctcaccgttggacgcaaagtcccaggttttcgctggagaggaggcaccaacttttcggctagaagagctaacccacaggagagggaggccagcaccctcaggcagtggcgcagcaagctgccctttgaccggaggccggaaacgcagggacttctgggggggaacccaagcttctgtgagtagacacccagtggcagataggcgaaagcggaagtcactgctagcttgatatatatttttttaatttaattttttttagatggagtctcactctgttgagcccaggctggagagcagtggcgcgatctcagctcactgcaacctccgcctcccgggttcaagcaattctcctgcctcagcctcctgagtaactgggattacaggcgcgccaccacgcccaactaatttttgtatttttagtagagacagggtttcacgatgttggtcaggctggtctcgaattcctgacttcagatccacccgcctcggcctccgaaagtgctgggattacaggcgtgacccactgggcctggcctaatttttaaaacaagtcaaattttgagtctattttcagttttattcttgatgattagcattttgtaataattgaaacctagcaatattcgtggtcttataaaacaattggaaaattggaagtaactaagtcgacctcccctgttccctcatcctccttgcccctccataaagccaacattgtcttgtcttccatctttatcattgagaggttctagctcagttgggaattaagtcatttgcctgcttttgtgacacctatgcgatttttacagttagaggagggtctgctgacaccattagctccatcaaagtaggataaaaaaggagtggaaagtcaagtggtggcactgtttgttttgttttgttttgttttaaatctcactaagtaggtgtgttggggaagaaatgggtaagaaagagaagtatatgtgatagatttaagagacttttgtgtctgaaatagttgttccacagatagataggacatcagaatttataatgcaaaggcagagagaaaaaggaaagttatctgtctctcctgaagtttaaaattctcttttttatttttattattttttttgagacggagtctcactctgtcgcccaggctggagtgcagtggcacgatctcagctcactgcaacctccacctcccaggttcaagtgattctcctgcctcagcctcccgagtagctgggattataggcgctggccaccacgcccagctaatttttatatttttagtagagaaggggtttcatcatgttgtccaggttggcctcgagctcctgacctcaagtgatacgcccaccttggcctcccaaagtgctggattacagatgtgagctaccgcaaccaggctgaagtttaaaattcttaaacctttttattcacagagccctctgagtagcaggcaacggcatttgaccttctcagaaaaatgcacataaacacaccatctggcataaaattttagggagttcattcaaaacacctcatctaaagtaaaaacacagcaacttcccttactctgtcttcagaaatgatacgaagattgggataagcgacccaaaaggacatacacaaagcacataaaaaggatcattgatgctgaactaattaccaattaaatgatatatttggaattaattcaaaagaatacagagtgtatactgcgcagtgggaggggagaggagaatatagatgaaacaagattcaccttgagttgatagtccttgaagctacataggacttggggattcactgtgctatttgctgtaattatttcaagatctaacactttatttattccattttcagatactctcttaacttactggaataaagtatcacctcaggagctcataaacattcttatacttttagagtaagttatattaatttatcttcatatactttccccttatttggggagaattcaactgttacaattttttctgtttttaatagcttatttgctaataatgtagaaaatgttaaattattttgataatatagagcctgacatagaggttctttacctgcagacagaagaaaaatgtgaacgtggaatactttgtatactgctgaaactctagctaataataaaccatctttaaagcccagcaaaaggctttctgtgatctgaaaaactagaagtagtatcatctgtcgtgcatcattcatttggaacagatgctggattagtggagcagtgtaaatgattggaatttagaatttgtactttcatgtagagctgagtaattctacccactgcagaaatgtgtctgtgtatttgtgtgtacacacacacacacacacacacacacacacacacacgtgtatatgtatgtattccaagactcttggggggaaacctagtctggacatgggaagttgtcctatatttcatcctgagctatttttatatgattattggaagctaaaagaaaaattagagatagaatgaaatgcaataaatttttaaataaatagtacacgtatatgatttgtatgtgcatgtctacaaaaacaaagcatatcaatacaaaacccttggattaaagtcttacaaacttttacggaaaatgtcagaagaataaacagcagttaagatttttttttaactactgtaattgtactgaaatatttactaatgaaaatatctgatgttggggatttgctttagaaacacaggggtagggagggtggagggatatcaggggacctattcagggcagaggtcaaacaagaatagccatgagttcaatcattgttgaatctgggggatgattgggtatgtaggagttaactatggtactctccctacttttgtacgcgtttgaaatttttaataatataaagtattttaatgctattatttaaaatgtagaaattgccccaatttttagt[134 bp omitted]caacatagtgagacctgatctctacaaaaaataaaacattagctgggcatggtgatgtgcacctgtggttccaggtacttgggaggcagaggtgagagaataatttgagcctgggaggtcgaggctgcagtgagccgcgcatgatcattccactgccttccagcatgggtgacagagcgaggtcctgtgtcaaaaataaaaaatgactgatggagacctttgctatgataagttacagagcataaagggtgatttgcattgacaggttttttaaacctgtcattaaaattgtatatgaaaacatgatgtaattgtagcaaataaatgtagaaagagaatatggcaagcccgcaattaattatctatgtatttctgtatagcaaaacacttatcattataatatgatttaaataggctattctttgtaacttatgacttttaaaatatcacttgttaatctgtagaggatgttaatatattactaacatgctattgtttttctttctagagtatgcttgtttcactttagatatatggggaaaagaaacatagcaaggtaattcccatagcactgcaatttctactttttccttctcttccaacagagggcaatcttagtcatgccatgtaaaacctaggttgcatactttgagttaacattgggataccggtgatttagttaacatgtcccaattgaaagtttaaacgaatgggaacttttacattttcaagcttcccaaggagtgatgattaaagtgatatacagagtttctaccttgtgagatgcttatcttttctaaaggaatccagaagaggctagatccaggggaaggcaggaaatcataaagtgaggacaactgtaaggtctgtatttttgtctgaaaactatcaatactcacctcagttactaaagcaaatagaaatccccaacagcaattgggacataaatgatacattatctatttcctctttttgccatgtaagtcctagtgaaataaatacttaaggaaatatttgagagattctaaggtgaagaaggttacttgcttatttcaatgagatgtattttaggggtagagttagtcattaaaggagctcaaaaacagttttaaaaaatgtttaatttttaagaggctgtgtggatggggattactgttcagtctctggaacgtcctaaggataggtagtttgggtggtgagggttccaatttcaaccatgttttcccataagttggagctggtatggccattgttaccatgaacctcagtctctaggattctgtcaactctcccactacgtttactagaggataaacaaactatttcttccttagtccatgtatgacccagttgtaattttttaaatggaaacaacattaaagtaaaacaaagaaaagtttgttcatcttagcaatggacatgcttacagagtaaaaatttctaatccaaacttacctcaggttcagaaacagattagattggcattcattcttgaacatctggctctaggagtttcccctctcatttcaactcttagtgaacctctggctgtcttcttcccactcttgcccttcctcacctcctgtgaaaagattaaatcttattggagtgttggccacttatctctgatgtttttgagaagaaggagggaagtggaagctctttctaaattccttaattatattcatatatgctattttaaagatacattaaaacttcatccagtttctagtgacacttcatttaatccttgagtgtactactatgtttatgtggaaacctaattttttttagttaaaaagatgataacattgagatatgttattagagcactccagttcctgactttaaaatttattttagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagtaagtgaaaatgtgtgtgtggtacccatttgaccttaaagaagtcctggtttaaataataaaaactgaaggtgatggataccataaataccttgatcattacacattatatgcatgtaacaaaatatcacctgtatcccttaaatatgtatgaagaaaagaagtcctggtttaaattgccaatatgatgggaaatgatttcccatacatgtgtttgcatctctctgctatgtatataatcaatttcatcatacatgactataaaatgataaaatacacatggatttttgaacaattttaggtcatgatgttttcttcttagtgttaaagaaactaaatttttcccatggaattgctattctcataatatttttatattgagtattcttcattcctactgttagacttcaatgcaaatattgacatcttaatataatagtatatgtaatatttgtttagttacttttggtcatttaatgattagggaatgaacatgctgagttgactgcagaaatcggtgaatcctaaatactagtttggcaaaggtgtatttcagacaggttgaagtattgacaaggcaaatagggcaaggagagaaatcttgcccaactgcggaagctagagggttatataaatggaagctatcctatgaaaagcaaatattaataacaactcaaagagtgagaatgttttgtttccacacagtcctctgaaggtttcagaaaaggaagccagcaaaactggctttgtggtaagacctagtaataaaaaataatgttttgctagaccctgaactaatagactcaggacctttaaatctgcatgttttaaagccttcagcttcttgtaaaaatatgatgaaccacttccttcagttgcctccaagataccttgttttccttctgatttagaaacaaatgtcatataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctcttttttttgagacggagtctcactctgtcacccaggttggagtgcagtgacgtgatctcggctcgctgcaacctctgcctcccgggttcaagtgattctcctgcctcagcctcctgagtagctgggattgtaggtacgtgccaccatgcccggctaattttttgtatttttagtagagacaggtttcatcatgctagccaggctggtcttgaactgacctcatgatctgtccgcctcagcctcccaaagtgctgggattacaggcatgagccaccgcacccagccgagccccctttcttgtcttaagtctttgggtagaaagtcattcaacaccattatgtgcatcttcgtgttgggaaaagtttaatttacttttttaatcctaggttctacaacaactgaagcagacattttccaccaggcacttcttgaaggcaatacagctactgaagtttccctaacagtactagacaccatatcatttttcactcagtgcttcaaggtaaaaatgaagagttataattcagttggtaccattgcaaagtaacattatgcagaaattacctagtcaatgtggggtagtacactgaaaaaggctggcatgaatagtcaggaaatgtggatggcagttctagtttggttatcatgtgaccctggaagtcactgagactcacttgtgtcatccataaagggaagggagtggactaacttgcccttaagctctcttctacctcttaaattctattagattttcgtatttaaaaacaaagtttccatactttaagtagccagcaatttttagcccaaaatatgattggatctgtttgcccaaatacccattgtgatgagatgtcctgtcagggtagatgatgtccgggcagtctggctggcttccctaggcgcgcacttagtgttttttctcagatgtttgcctctcagtgcaaatcatcattgctatgattttaaaaagaaggtaaaagcagttatctagcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgattaaaacaaagttgacaaactaaaaggtatttctctacaatttgttgtttctttgcaagggacatttaaacaatttacatagtctgttcaattgtgatacctgttaattatctctactcatagagggcttattttttcacaaatggctaaccatatactaaacatacttttaaagtaaattagatcataatctaataaaatagaactggtattttccttcattcatacattacaatatttagtctctcagaaatacaaaggctgatttgcttgtattcattattaatttattgatttcttaattgagaagcaatatggtataggttaatagaaaatactcttcccatactagtcctgtatattgctgtgttgcattgaaaaaaaatctacctgtttaaaatgttgggattaaatattttagatatcatgtatgtagtagttgtttgagatttccaagttgaaagatggcacaaatattttgaaattatatgcaagagccttttattttcctgaaacttccaaacagtggtttcataaacaggtattggtgaaatcagttctgtcattctcagtggggcataaaccatattttttaatgttttatagacccaacttttaaataatgatggccataacccattaatgaaaaaagtgtttgatatacatcttgcttttcttaaaaatggacaatctgaagtgtcgctgaaacatgtatttgcctcactgagagctttcatcagtaaggtaaggacagaagcttgggagcagccggtgggctctcttcattgcaaaaaggaaagatgggacaatgggggtcattgtggtgacatatacaatgccagctcatgaagccattaagtactgcctttgtaaatagaaatacagaacaacaaagcacacacagagggcctaccatgaaccccctcaaatcagaagctactttttatttcaccccatcataccttcccttttccattaagctcctttgaagaatatcgttttaaaattaccaaacctgccagttctctattttgcttctttttaaaagtattgtcatgttggaggtatataagccatgagtgcactcatgtctaaacactttgaaaggatccaacttttgtaatcccagggtcttgtataatatcttggaaatggtaagcactcagtacatgttcaaatggatgaatcctgcctttcaatgctagccataactgagggccctaaatgtgcagtccacttacctcagctaaacaataacctcagacttggcttttaggaagaaatatgactgaaacagacagcaaagatttattttctgtgctcaggggctttttaaacttaagaataaacataattaaccaagatagagccaaggttatggaaaggcacagtccagatcttccactggtttatgtaactacaataagacaaagaaattcagtttctttatttgtgtaataggctagctaagctttgaaaactttttgccatcctcattatttagatagcagccaattgtgtttaatagatacagaaattagatgaatttgaagctttttattgccattctttaatataatttatgaattaatctatgggaagccaagttcaacacaagcatgttacaaaaactaagggaaagagattcagaactaattcatttaacaaaaactgtaggtacttactggatatagtccctaaaggcttattgtccagtagagggaggcacacacacatcaagatacacatacacagaaacaaataccatcaggataaaataagtctgtatagacctctgggggtgagcaggagaagaactctaatttagcaaaagtttttctgcagcaacggagctaggatttaatatggattcaccaagagatgaaactaaagatgtaaatggagtacagatcatgtggactcatcttaagagttggatttcatctttcaggcatcaggtagtcatggaagggttttaagcagggaagtaacacaattatatttgtattaagagggaattggtaaggactggggaaaatctctttaaaagttgtgttgaagaaggattggtgacaatgtcaaaggcagtaaaaagactagttgcagtaagctagataagaaatgagggcctgaagtaaggcagtgacagtggatatatgaaggatcaaaggcagatgagacatgttgaaaaaggatttacaggatttgatcatcagtccactgacagtatggtggagtgtggtggttgatgtgaaatacaggggaaagactacatttgcagtaaaagttaatgagtcctgttgaatttgagtgcctttgggacattaggatatatggatctttgctctggagagggatcagattggagagccagagttggagtcattctccattcatccatactatatttattgaggaccttctctgtgtcaagtgctgtactaggtcctgtagatacaatggagatacaaaataaatatactctttgccctcatgaagcgttcagtcttagtggggataggggagacagaaaata[131 bp omitted]accccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagttaaaaaaaaaaaaaaaaaaaaattagctgggcatggtggcaggtgcctgtagtcccagctacacgggaggctgaggcaggagaatcacttgaacccgggaggcagaggttgcagtgagccgagatcgcgccattgcgctccagcttgggcaacagagcgagacttcgtcaaaaaaaaaaaaaaaaaaaaaaacacaacaacaacaacaaaaaaacagagagacctgaattattgaaaaggggccagctgtaaaaagagcttaaagaagaactatctagggagaatgacatacatgtgccaaggctctgagttgggaaacagtttgcagtattctgagaactaaaaggctggtatttttggagcatagtgaactagcgggagcatcaacatacaagtggtagttgaagccatgggagtggtttgattttccctggagggtacattgaagaagaagaataacaacaacaacaaaaaaaatcaggagcagaacattggagagaaacaacgtagaagggaggttcaaagacgaatctgtaagggagatgagagggagcagtcacagaggtgggaagaaaggtaagaaagaaggatatcatggaagccaaagaaggaaagagttccaacattgtcatgacgtatacggagtagtcaaataagaaaggagaaaagaggtctgttagaattggcaattaggtcattgatgattttagccattgcccactcagagaagtgagtgatgtgggtagaagacttagtgtagtgatgagctacactatagctatgatctcccttaaatgtttattttcataccagagtatctgcttcatccagagttagtttagtttggtgaaattattagcgagatttcccaattcccaatcagaaaacatttattaagcattcattatctgcatagaattacacttggtattaaggtgaaataaagggtagattcctatatgtgggtctaaattcaaggttcctaagaaataatttttaaaagatgtccctctagcttcactctctgaaaaacatctattgtgtatcctgaagcagcttgttatttgcttgcctagacctaaaagcatgggaaattgtaacaagtctgttacctgtatattgtgtcttccacaaagcagactgaatacattcttaaaggaacaggccacttgtctcttttgataattagtcactttcttactccttttctatgctaaaatgtatcttaactatcagtgtttatgtgaagaggatatgtgtgtgtgtgtgtgtgtgtgtgtgtgtgtgtgtgtgtgtgtgtgtgtatctcctatatcccatttgttaaaagatgaacttcacttgctgagtagattttagctataattttctcagcacgttgatgttcacaataaaggaactgttgaaatataaagcaaaagagtaagtaatgaaaattgaccttcccatttttaagcccccatttgagacccatcattcatcatttcaggcattctttcaaaacatattgagaacctgcttactgtattatggcggtgcaaaagtaattgctactatatcactatatagtggcaaaaaccgcaattacttttatatatattatattattatataatatattatataataatataatatataatataatattatatattatatatgttattatatattaatataatatattaacatataatatatcttatatattaatatataaatataatatataagatatattatatgttaatatattatatgtttatatattatatattaataattattatataatattatattataatataatatataataatataatatataataattaatataatataatataatatataataatatataatatattataatatataataatatataatatattataatatataataatatatattatattattataatataatatttaatatatattataatataatatttaataacatgtaatatataatatttaataatatatcatgtattatatattataatattatatataataaataatatattttataatatataataatatataatatataattatatataatatataataatatataatatattattataatatataatataaattataatattatataataatataatatataatatataatataaattgtaatatatataatataaattgtaatattatacaatataatatataaattgtaatattatataatataatatataaattaatatataataatataatatataatataatagtaatatataataatataatatataatattataatattatataataatataatatatatataaaagtaattgcggtttttgccactatatagtgatatagtggcaattacttttgcaccgccataatacagtaagcaggttctcaatatgttttgaaagaatgcctgaaatgatgaatgatgggtctcaaatgggggcttaaaaatgggaaggtcaattttcattacttactcttttgctttatatttcaacagttcctttattgtgaacatcaacgtgctgagacaatatattattatataataatatattatattgatatgttaatatattaatatgtaatatatatatatttatatatttatatataacataaattatatatattatatacatatatataaatatataatatatataatatattaatatataatatataatacatatataatatataatagatataatataatactataatatgttgcagactctcgagctcttctcagatctatagcatttatattcagtacttctacatctttgtaataacttatatactgacttaagttctattattatcacatgctggtgtttatgttaactagttcaggctctctggagagcagagcctgccttatgttgattttgtatcctcaaagcccccagcatagttttaggtgaggatatagagggcacttgatattctattgattttatgattggattttaaatacttatttctgttttccctgttctttagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacaggtcagtgaaaataaaagcgcctcttcatctttcttctcttcaatctttaacctctagatcaagatccagagccacccaatccagtccaatacaatgtggccatctagcacttgatgtgtggctagtctaaatttagatgttctgaaagtgtaaaatatactatggcttttgaagactaagtatgaaaaaaatagaagatctcaattgttttatattgattatatgttgaaatgatatgttgcctgtattaggttaagtatattaaaataagtctctttttagtgtggctactaggtaattgataattacgtatgtggcatgtgtcatatttctatggaatagagctgctcctgagcagagaagagcataggctttatttcaaattttattttattttattttattttttgagacggagtctcgccctgtcacccaggctggagtgctgtggcatgatctcggctcactgcaacctccacctcccgggctcaagtgattctcctg[134 bp omitted]taacctcccaaagtgctgcgattacaagcatgagccaccgtgcccagtctctagtttaaatttgaggactgccacatactatgtgacctggagcaagttacttccttagcctctcagtgcctcagtttctgcaaatctggtggggtaaatattgttacctagctcataggatttttatgaggattaaatgagatgattaaataacaagcttgttagattttacagaacagataacacagtttatgtttttcatgctccagtatgcccacttattttaaaaatgagagatgtgtcaaggtttagtggaaagcattgactttggaatcaggcctacctgcacttaaatcatagcttaaatccttacatgccctgtgaccctaagcaagtcactcaatctgactgaacctgttcccttatttgtgaaatgagactgagtatttcactttgcagagttaccctgaggattaaaataaggcgtgtatagtgcctatagtgcctgacacaatgtgtagcacaagatagatacttcctacatgatagttattattcaacatctccatacttttgggtttattggatgaaatagctctgaactaaaccacaattgggactgcttgactcagtagccttcattgtaatatgggaaatccttggtcctatttatatctttactgtcatggtctgtcccattagagttgtttactggagataagattattagtggggaaacaaccataagcagcttgttgaaaaatgtcatcaataatgtgaaaatctaataggaatactgtgtatgcttcctgtaaaagtctgctatataattacttttgcatgttagagtcagccatcattacacattaggtcctttactatttgcttttatatgagatggcatttggaaacccaccttcccctagaacattgttctaatttgtgtgccaatatacctgaaattcccccattggtattgattcttctgggtcaaagcatcagttttctttaagtcttttattcaaatatagacaaattaataaatatgaagacttagaacactgtctggcacataataagtgctcaataaaggattaactagtactctaatggttatgatctctttcatcctctacaaagtagggatttttatcataggcattttacagatgagaaacatgaggcacagaaaggttaaatagcttttccaaagccacacagtgaattattgataaagtcaagatttgtatctaaggcattcaactctagagcccatacacatggctattactgtatcttgcttcctaggaccagtggtaaagcatccagccattaacatcttagtatgaattgttttggcattcacccaagggagactgagagatttaaaagtcccatcaaagacagtggttcatgcctgtaatcctagcactttgggcggcataagtgggtggatcacttgagcccaggagctcgagaccagcctaggcaacatggcaaaatcctgtccctacaaaaatataaaaaattagttaggtgtggtggcacacatctgtagtcccagctacttgggaggctgaggtgggaggatcacctgagcctgggaggttgaggctgcagtgaaccagtgaaccaagaccgtaccactgcattccagcctgggcaatagagtgagaccctgtcccaaaaaataagaagtaccatcaaagtccattccataaacttctgttaaactaggtaaaccctggtcaaaaacaaagaaagttgctgaggcactggacttggaagtccagccaactaaaatagactagtgaaaaggaatgagaaatcatcaaagaaaaacatgatttattctcacctttgccacagctacaacctagaaagcatatttaaaatggagacctgactaccattgtatcagttcactattatgaaaatagttttagatctggctatgctatgagttttgaaaaattgtttacgtctaaccaagaaagatcctttaaaatttgaaatagggcctttcaagttactatttcagcagaagaatgtaaacccctcatgtatgaagggtacattatgatggtacagtgtagaatctttaaaagaagcatttcatgtgagtgcttatatacttataaaatgatgagcatagacagcatttgttcaaaagttatttggaaaataatatttacttcttcccacagataataattgctgtaagccaactgatagctgatgtagcactaagcggaggatcaagatttcaggagtctttattcattatcaataattttgcaaatagtgacagacctatgaaggtatgttctcatttcagataataaattagaaccacctttgctatcagggaagtttaaactcttaaactgtcattggattcacaacttttgttagtatagaatgtacggaatgtgagttttatgagttaagggctttgtcttatacatcactatatctctagtacctagaacactgcctggtacatagcatatattcaatatcagtttagtggatggatgaatgaatatactatgtattcatagttgttatggcaagtcgaatctgaattttttttttctgggcttcatttccaaacttgctcagaaaatacatagatcctttatttcttaacaattgtcaccacttttaatattggttaaaaaagcactgaatttgaaatttcacaaaatttcacttagaatagctaacagttgcctgatccattgccaatggatgagaaatggcacagaagggattcattatttgatggttttgtgagttttgaaaattatctgttaacaccaaggctgtcactcttaagcaccattttgctgaggccaaacccaagactctgaccactgttccactttctttcctatatgcttaaaacttatagcactgtaaaaattcatctgttgctttgttgcgtagagtgcaggttctgatcttcagtgacacatgtatacaagggaagaagaatcctttgccaataggacttttcctcccagaagaatgaatcatccccattcttgggaaaggtcatcttccagcacagtttgacaacattgtgtaaaatctgaaaaagattaaaagctcatagtcacagcatatttgatgtttggatgtgtagaatctaagtaccaaaaaatattcccataggaatgttgcttgtactgaaaaataacagcgtgtagtgccagccgctctcaggctgggaaagtttgctttccagccagttctactagttccgcaggggatcagtatatgctccagctaatcttgtgagcatagaaacaagttacaccacttatgcttatactctaaggaattgtttttaccagttgttaccatccttagtactatgttatataggtagattggtaagtttttctaggtaaatggggcttgtatattctctccttgataggaaatctttttcttttccatatctcatttatgaaatgacttagttttattctgttatggcagtcattaccaacaaaccctattacgaaaagatacagctttcccctggtaaatgggatctctattaatgtatagaaaggaactttatgtatataattattatttttaaagggagtcaaagccaggtaggtattttttatttctattgtatttatttatttacttagagacggagtttcactcttgttgcccaggctggagtgcaatggcccgatcttggctcactgcaacctccacctcccaggttcaagtgattttcctgcctcagcctcccgagtagctgggattacaggtgcctgccaccacgcctgggtaattttttatatttttaatagaaatgggatttc[131 bp omitted]ccacatattgtgtttatattgacaagctccctaacccctgtacctgtctcttcctcatcatctctgaatcatatagataattgtgattactcctgtgggggttaagaggatgcaataggacttccttagcagtggctagggtaaagaggaaactctggtattcttggtgccaaaaacaaactttgaaagcttaatgatctctctaaactttctggaacgttctgtgattcatgacctcccatttgtgtaaacagaaatttctgcagtatggttttcaccttagtgtatgtggtagttagtggatggagtaggcatgcttatcagaatggaagagtggccaagagcaccagctctagggccagactgcctgggtgaaaatcctgtctctaacatttaccaattttgagactttggtcgagcatttaaacacttttttataatagtgcttaactcatagggttgtcgtaaaaattaaaacatgtaaagaacccagactagtgcttggcacatagtaagctattagtttttagttactgttacaagaaaacggcaaacaaagatcactcccatggctgtgcaattcacaatggaggatctgggattcaaagccaggtagtctggctccagagctaatgcttttatgtcctgtgaatgtactgccaccaaggttagagcctttgaagcctgggctagttacatatttaaaaaataatttatttaaaattatttcagtgtactatatgcaataccaagaactgtaacaggaagtgaaaatcatatgtcctcagcattggatgacaagccttagagcacatcgatattgttgttcaacttgtcttttttgtttgttttgaaattaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggtgactacttaaagttttgttctaaacagcccttcaaaacaccttgagcatgttctgacagttctttctctgtcatcctttttcaggctgcgatgtgttatgtccatgtagcagctctagttgcagagtttcttcatcgaaaaagtaagatatttctgtttttagagatggggggattttcatttagcataatagttttttatctttgtagtttagctatgaatatgatataatagaacactgaaaaatatgttcacccttggccttattcagtgttaaaaataagctgttataaaagaagactggattgtttgttgtcccttctgctttcattagagattacaagaaaagttaaatagtacagggtggccaggtgcagtggctcttgcctgtaatcccagtgctttgggaggccaaggctggaggattgcttgaggccaggagtttgagaccagcctgggcaacagagtgtgatcctgtacctattttaaaataaaatataaaatataaaaaaaaaatagtacagggccaggcctgatgcccagtgtttattttccaagactgtccctccctggaagactgccacaaattaaactcttctcaaggctcaagtcgggataacacagattatttgtttccccgtcatgtgtcttaacatcaccaaactgcccatagactatgtctctccagccactttagtgcagtgatacctgggtactaaaagggagtcatactcttgaagggctttaggtccagcagccctggattcctaatttaagattcctaattcaggaaatctacttggaagtgtccctttccataaacagtattgttggctactgctcaacagtattgttgaacaaactgcatctgctcaaatagtaacccagttgagttaggtttaaacattgattggcaatggagctggcaaccaagaaatctctatctcaatgtccaagctacttcctttaaggcagtggaatgagtaacaatacggcaaaatgaaaccaacttattaaaggagtcatatcactctggcttcagctgtacgaacacaaccatattttgttttattttttaattacagaattcctacagttaactgtatatctatcatttcacactgaggctcagtgtttgattgcctcatataacacccatgtggagaatctttttctaaaaagattcttggccgagtgtggtgactcagacctgtaatgtcaacactttgggaggcatgggtaggtggatcacttgagcccaggaatttgagaccagccttggcaggaatggtgaaaccccatctctacaaaaaatacaaaaattagctgggcatggtgtcacatgcctgtggttccagctacgaaggagggtgaggtaggatcatagcttgagcccaggacactgcacttcaacctgggtgacaggacaagaccctgtctcaaaaaataataaataaataaataaataaataaatgaataaataaattttttaaaaaagattcttcttaagtaaaatgtagattcattttacttatattttaaattaacactttctgtctgactctggaattcttttgaataatctatgtgtttgatatactttagttttctccttttagtatacatatgtgagttttaaacagagaaggagattaattaccaaaataaggccccatttgagggtttttttaaaaatcactggtatgcatatgaaatcacagtataagtaaatattgaaattacacacctgaaattccaaataaactgacaagatatgagaaccttaaacggagtaccgtgatttcaagtatgtcttcagagaaatagattaatattatctcatctttttaattagaaatctggccaggcatggtggctcacgcctataatcccagcactttgggaggccaaggtaggtgatcacctgaggtcaggagttcaagaccaccctagacaacatggtgaaactccggacgttgtggcacacacgtgtaatcccaactactcagaaggctgaggcaggagcgcttgaacccaggaggcggaggttgcagtgagccaagatcacgccactgcactccagcctgggcaatgagaacaaaactccatctaaataataataatagcagtagaaatctgaagatttttatgtccactaagtctaaaactgtactttttagactttgaaaatagttaattatattaaaactatttcctggaatgtttttgtttttttcacaagtgcagagacattaaagctaagcaaaaatcaagaattatttgtctttattatcagtccttaagctttagaaatataatttcttgctatggtttttctggatattagcatggggcagctagcataaacaccaaactgatacatttcaggaagtggaaataatattttcaactagccatttatatatttcataataccctcaaggtttcttagaatttattcttcatagaaatcaaagcactcttcactaatgaggagaaaatgttgttttgaatgttaaaaaaaatgatgtttaagagaatttacatatttatttataggtgtcatctatttttaaatttcttttaattaaattttattttattttaagttctgggatacatgtgcaggatgtgcaggtttgttacataggtaaacatgtgccatggtggtttgctgatgccatctatttttaaacctggaaaattctatttgcctaaattagaaaaccttattctaaaatagtggtagtagtaaaagtcctcagggttttccccacttagcttcagtgatccaaaacaccttttttttcttaattagctgattcaactatgctagctataccgaggtcgactaccaatttaaaacacaagttaaaaacgtaaactgagtattattctaagtgaactaactcaggaatggaaaccaaatattgtatgttcttgcttataagtgggagctaagctatgaggatttaaaggcataagaatgatataatggactttggggactgggggtgggggccagggaggaattaaagactacacattgggtactgctcgggtgacaggtacaccaaaatctcagaaattactgctaaaggacttatccatgtaacaaaaaatcacctcttcctccaaaactattttttttaaaaaacctgtaatctgttaacctcccatccattctgagaaagcattagtgagctttttgaagtctagataagacccggcagttgacagagtaaatgaaaatacatttgagtgcagaactgaaaaaaaatcattgaatttacacttaagaccaacgtatttgacaaagataattgggcacctttagaactctttgttttctatcattaagtgccctttgataatgaagccaagagggaaggagcattagagtatattttaaatccctgatacatatccattgccaaaaatgttttgttttctctaattcctaaccagtttctcttgaagtacattataaaacatttttaaatcaagatggaataaaatactactcatcagttgacacattggaagcagatgttctactgtgtagcgtttttaaggaaaaaaaatactttgccctattggatcattgcctaagcagggaagggcttaggggcccttgcccctcaaaggtgactgcacagcacccacaagggaccatttccagatccttttcttcactgtgtcaggcactgaattgacaggaaaagggaaaggaggtatgcagtactccctgcccccaccctcaccctaccctcaaacttctttcaggcagcctgagctcttgcttgttctaccaaagagacttaaggatcactattctcttccctttattgaaggcacctcaaagtgataatactgagtgtcagctattctccttcctcccaaaaaatataaaataaaaaatgtcagaatttgcttatttttattttgtttgagaacctcaaattttctagatcacattctcccttttttcttttcctaagagagggtacaactgttttccccagggaagacaagagtcaagtctctgcattctttcaccaccaaatagcatcctaggttcagcaaagcttcaggcctgcaaggattcacccatcaacccagaaaaaggaatttcctttcccatagaatctggtttttttcattccttacagggtaatgttgctctctttcccaagacgtggtatccaggatctgatagcttgagtttcatgaagctttttattccctcattctttcctagtcatagcttttccccttcttatcctcccctcaggactcttagctcttatccttcttctgactggccatcctttttaatcaagggttgcactgctatcccatcttccacaccccttcccactttttttcacgggataacttggattcagggttatggtctctatctgaacagtttccatcttgctttccctagaacagcagtcaggaatacagaagttacagctataaacagcaaggtcaagagtcctggtcaaataccagagaaactgatagcagactctccaggaccaccttctacagggctgcataggtctacatgagatccctcaaacagatgcatccttctgttgggatatgtacattggccaattctagactcagcaacttgtttcatctgaaaatctttctagaactaagaggaatcaggattttctccaagcattttaaagattctaacaaagggtcgtgatgtaattggatattgatgggtgttgataactttagcaaaaagggggaggaatatagtcatctctgggtagagatccattatcaggcagatgcattaagataacacacttagcaagaatattggactctgaagctgaaaattcacaatagtagtctttgcactagataacccagacacgactttcaaaagtgggtgtttatgtctttgttcctgagataaaacataattttccctacttctacttaagatacaccggaagactctagcaagatgcttttagcctcatctcatctggcataggagtgtgcctttcttcatcctcccttaaatcccagcattctagaaaagccctacatttggaaatgacttaaagtaataatctcttttgaacagatgggaattttttttctcccagtcatggacctagctgcctgaggccttcagggattcactatcttcttcaataaaggctatgttctttgtctcttcactcaagtcttgggccctcttctttacggcctggctcttgacctgatagtgctgatcaagtgggatggtttcttctacatttcaaaaagttctcctaatgcgctactgcacaaagagtatcccacagaccagctgctagtctgagaactatttatcacatgtttacaacaagataaggagtattgtcctgaatgtaaattaaccatgtcactaaacactctgtttgttcaactgacttgttccttttaatagaaagactttgttgaagaaggaaatgaggaattgatttacattctggtgaaagttccttatctttttatggtccagtactttgaatagaactctctagaggtcttgtaacagaccattttaggcatgcttatcttcagaaatgaagcaggctatgttttatcttcagcgccttttatttattattattattttttgagatggcgtctcgctgtgtcacccaggctggagtgcagtggtgatctcggctcactgcaagctccacctcccgggttcacgccattctcctgcctcagcctcccgagtagctgggactacaggcacccgccaccacgcccagctaattttttgtatttttttttttagtagagatggggtt[145 bp omitted]tacagcttggtgggtcaaagtaaatatcactttcattcctggggctccttcttccttaattaaaactcactgactactcccatgtatttctcccttcttgaaaaagtatttcaaagccaggcgtagtggctcacgcctataatctcagcactttggtaatctgagatgggtaggatcacttgagctcaggagtttgagaccatcctgggtaacatggcaagacctggtctctacaaaatatataaaaatttgccagccgtggtggcttgcaccagtagtcccagctacttgggaggctgaggcagaaggatggcttgagtccaggaagtcgaggctggaatgagctatgatcacgctactgcactgcagcctaggtgacggggtaacactctgtctccaaaaaaaaaaaaaaaaagtatttcaaaataatcctatcttcccctagcagactttcatctttctctcaaagaagtgtggttcctacttctgtgtgtggttcctacccatgttctgttaagcagcttacccagaagatacatgtctagtgattaggtttcatttagacaagaagagttggaaaaatccaagccctgatatataacctcttttccaccagaattctgagaaatctcttcaacatgaggtctgattttttttttaaaccttccttcttccttccccaacctctaacaggaagattaccagatacttaattgtaagtaaaggtcattatttgtaagtatcactgttaggttgtagaacagtagattgcaacagccatttttttgtgtctgtgtgactagctcctatcagaaggaaactttttcattgaaacgttttcaatggttatgttataaagaggcagaattttccttgaactctaaaattacagcccacttagataaaggtaaaggcagacacagtaggaatgtttacacatgttcccctgtctagaatctataggggaaccatgtggcctttacacctcgactgttgcttgacagtaacaatttggtccagaagcctacagcaggtgttctcagcttgagttcacttcctacttcccaggagtccagctggcagccattattttattctaccttgagaaggctagtttatttattggtaggcttatttgctagtaataattcattgagtacttatttactaggctccattctaaacactttacatttcatttaattctcatagcatagttatttattatccctgttttacagatgataaaactttttatagtcccagggagataaacattagcacaaaatcacacagttagtgatagagctgagtctatgtaactccaaaagtggtggttcttccagtgccccatcctgttttctctaggatgcttcatccctgccatctgttttatttcctgactctcttaaaagtcctaggccagaccttctccaacatctcacttcctctcccaaatctcagtgaaattaggcactagacatggttaccaaagatcacttagtggttacctgaaaagtgcctgccctcttgtttagatgatagaacacaaatgtatacaggatcaaagtttaaataaaaatgtttagattgcactaggtaaacatctatcctagccattgaagatgatacatagtcaaagaataaaagttattcataactaacttaagctcactttgtagggggagaaactaataaaatatgtagcaaatggaaacaaatttaaaaatttttgtaagtgaaaattgtacttaagactttgattcttacaaaaataatgtgtttattttaaatagcccatctctgtaaggctcactgttatttactaaatgctttctcataaattcactccactgttttttttattcacacagaattatttcctaacggatgttcagcgttcaagaaaattactcccaatatagatgaagaaggagcaatgaaagaagatgctgggatgatggatgtccattatagtgaagtaaggattccagggcctgcattgccagttatataaatttcacttcttaaaattcatatatattaaacaattattacagctaacctaattttgaaggtaactaagggttaatgaactttaagtattaaaactgtccagggcaaagatgttcctgtttagagggccctgtctcttgaactggtcccattgtctagttttagaaatacagcatttgccgtcctcaagtcaccattccaataactagataagagtcaacacatgttggaaatttttccataaaaaatagagttaacattgctctttacttcaactaagacagactatgcacaaaagtatttttaaatggaaaatttctgctctaaacaccacatggatagaaaacagctttggctgtcagtcaaccaccaaagatttattgaacattgacttaacagcaaggccttggacttggtgacctaggagctttaaataattaaatatgattagtccctgacctccaaggtccacctgaagagataatacatgtacatgaaatggaaaaaagacttttgaataatatttgaataatgcagacaatatgtgccatgcaaagtcaaaggtgaaagatgccttagagctcaggtaaaataaaggaagtatgatcagagagggattggaagaatgaggacaccctgaaggcatcctaagagacaggagaagggcagggaccacgactaagaggtaggaaagtgtaagacatgtttgaggcacagtgagtggaagtggatccttttggctatagcagtaggttcccatagagaagagtattagttgaggccagattttgagaaactttcaatgtttgggctttattcagtagaatattaaattggcatcaaagtcttttttttttttttttttttttatggagtctcgctatgtcgccaggctggagtgcagtggcgcaatcttggttcactgcaacctctgcctcccgggttcaagtgattctcctgcctcagcctaccgagtaccagggactacaggcgtgcaccactatgcccagctaatttttgtatttttagtagagacagggtttcaccatgttggccaggatggtctcgatctcttgacctcatgatccacctgccttgacctcccaaagggctgggattacaggcatgagccaccgcacctggcctcaaagatttttgagcaggatgatgactacatgaaagcaaggaagagggaaggctaatttggtgatgatgtgggagatgtattgaagatacagggataggagctagaggcaggggctagagagaaggctgccctaattatccagatacgagtagttaaggcttaaaccagggtagtgaaagattcaggaaatagtgtgaggaaaagatgctgatttgctggctgtgggaggggaagggtcaaaggtagctctaagatttcaggtttggaggttaagggaaaatgatagatggatggttttgcaggaaaagtgatgaatttcattttataggtgagttgattttgatgtgaaagcttatcaaaatggaaataaccatcaagccattagaaatgtggaactgaggctgggcgcagtgtctcacgactgtaatcccagtactttgggaggctgaggcaggtggatcacctgaggtcaggagttcgagaccagcctggccaacatggctctactaaaaatacaaaaattagccagacgtggtggcacctgcctataatcccagctgctcaggaggctgaggcaggagaaccacttgaatttgggaggtggaggttgcagtgacccaagattgtgctactgtactccagcctgggtgacaaagtgagactgtgtctcaaaaaagaaaaaaaaaagaaatatgaaactgaatctaaggagagagattagggttagaaatacacatctggaagtcatatccttatgaggaccaaagcagactgaatgttagacataataacggcaagtgaagaccggagaatcaaggactgaaccatgggggaaaagttcacaaagagtgtgaacgtagaaaacaagaaagaaacacagaaaagagattgaagttacagtcccataaaattacatttcttaaaaaaattgtattaaacaatgagatgaaaattacagtgacacacttcataaacactttatgaattgattttttaaaatacacaaatctcaacttagctctggcttatttagttaaattaatgatacacctagaagctttacctactatttctacatagtctgtctccctatcagtaaaataaggacaataatactatcgtggtcacttcacaatacatgcgaaaacttaaaaagtcatgaagtgtgagaataatgtcaggttttatcattgacctacttggcagtgagatttcttaaaagcaagttggtgtccttttaccctcagaacctacaaggatagatacttaaaatatgtttgttgaattgattgatcataacagagatgcaagatacttgaatttttattccagcttaatttttgactgtatagccttggacaagttaattcatgtttctggatattagttagatgatttcccagagacctgcaggttttacaggctgacagcaggaagattcagaggatttcatggggcttaactggttcagtacaactgaacttatatccttgccttctaaacagcagcttcagtgtattcatagaaatggctttgagcttgacccttttttatactcttaaggagagcaataacttttcttaataatcaaaaactgtaattagttttctgtataaacacatttgttggaaatcttttgggttctacaagtaatttatacatacttctatttgatatatacaggtagaatcatgttttaccaagtgccactttatttttcagtttgcataataaggcttcttccttaaaccctagccaattaaaaaaactgacactgatttagaagttacattgaaatgaaaaatacaaacagttgtccatttagtgcttgtatttaaatatgtgagttaaaccggtaataacgcaatgtaacttgtttccaaaaatgtatttctgacttgatttgcaacagttttttttttctgcatgacaccacctcaggaggtcctgatgacgtgtgcccctgcaatcgattttaaacatataattaatatataattgggctgggcgtggtggctcacacctgtaattccagcagtttgggaggccaaggcaggcagatcacttgaggccaggagttcaagaccagcctgtccccatggtgaaaccccgtctccactaaaaatataaaaattagccgagcgtggtggcacaggcctgtaatcccagctattcaggaggctgaggcacaagaatctcttgaaccccaggggcagaggttgcagtgagccaagatcgtgccactgcactgcagcctgggcaacagaacgagactgtgtctcaaaaataaaaataaaaatgatataattaatatgtaataaaatcttaaacaatttgatgaattttgacagttgtatacacccatgtaacctaccatcagaaacaaaaaatagaacatgcccattccttcgggaaaggttcccttgtgcccatttccagtcaggctccccacctccaccatctgatttctatcaccatgaattagtttttatggcataaaaatggaatcaatcattcaatatgtacctttttttaatctggcttctcttgtttaacctaatgtttttgagattcatccatattgttgggtatatcaaaagtttgttctttgtctttatatacaaattttaaatccattcagttgatggattttgaattgtttccagtttcaggctgttacgaataagtctactttaaacattcctatctatgacttattgttgacatatgctttttttctcttgggtaaatacctaggagtagcattgctgaatcctagggaagatatatgtttaacttttaagaaatttccgaagagtttctcaaagtggttggaccgttttatactgtttgccagtagtagatgagagttctagttgccccacatcctccctagcatctgatattgctgatctttttaaattttagccattctattaatattaggtgtgaatcaacatctcattgtggcttttatttgtatttccctaataaccgatgatgtctaccactttttcaggtgttccttggcctcttttgtattttcttttgtgaaatgtttgtcttttatccgttttagaaatcacattgcttactttttattgttgttttgtgggagttctttcctggatataaatcctttgtcaagatatatgtgctgtatatttctttaccagcttctgacttgaccattcactttcttaattgagtctgtggttgagcagaaaattttggttttggttgtaattgatgaaatccagtttattattttataataatttgttctttttgtatctggtcccaaaaatctgtgcctacctcaagatcctgatagtgttgtcctgtgttttctcctagaaacttgtttccgagttttgtttaggtctataatatatttaaagttcatttgtggaatgaaatagaggtcaaagctctttttttaagacagttttttttttttttaagacgtaccatttggggaaaaacaagactttccttttgtcacgttgaatttactttggcaccttggtcaaaagttcggtttttcatatttgtgtgggctatttctggattctcggttctcttccactgatctatttgcccatcttgatgccaatatcacacttgattactataacttaagtcttgaaatcaagtagtgttagccctccagctttattctttttcaaagttgttttggctattctacgtcctttgaatttccatataatctttagaatcatcttttctacttcctcaaaatagcctgagaatggagagtttaacaatattgaatttctcaatcaatggacatttatctgggttatctttaactgccaataatattttgtagttgttagggtagaagtcttgggttagatttactggtagatatgtgatgttttgatgctattgtaaataatattgtttgcttttatatttttattttttattatgttgttgctagtatatagaaatataattgattttgtatgttgatcttacgtcctgcaaccttactaaatctgcttattagttttcatagtttgtatgtcttttatgattttctacatatacaattatgccatatgcacggaacaattttactttttctaatcctgtatgctttttctctttctcttgccttattgtactggctagaaccttcagcataatgttggatagaagtggtgagagcagacattctaacttgttctcaatcttaggagaaacatgtctagcctttaaggtttttagtaaatgccccttatcagattgaggaagatctcttctattctttgtttcttgagttctttttaaatatcatgaatgggtgttgagtgttgtaaatgcttttttcttgcatctattgaaagagatataatttttcttttttattcagtttatgaggttgtatattacattgttttttttttctaattgtaacctaactttacattcctgggataattcatactaagtgtgcaccttatttttaattcccccaatgtttgtcccaaaattgctggaaattttaatttggctagcagatgttaatatacagatgttttattcaagtagcaacatttatttcacatatactatccagtgacactaaaataattactggaaaagccaatgtaagtaaaatattgtccctactctcaaagaatcacagcctattggaaaagtcagatatgtagataatacgtaaataatgtacaaatatagtgataaatctttgccaaaaaagtagtgaaatagaaaaaaagatgtgtagtgtcttgcctaccctatattgataaggagaaggatcctggaaaaggtgatacctaaagtgttttaaagagattaaccaagtagaagggattaaagggaggaggggcacagcctgaacaaagacataaagctaagacacaccattgtgcttcagggaaactgctagtagttcgctgttgttataacataaagtacaaagtttggtatgatgaatgatgagattatggaagtatcagccacatcattgcaagctttatgtgccacatgaaggagcgtgtccgttgttctgtgagtgatgcggagccattgccagattttaagaaagggagagtggcacgctcaggtttgcattttaatcagaaccctatggcagatgtgtggaagatgtatttgaaagggctaagactggaggcaggaagataaattaagaaaaaacaatagtgaaattttgcaccttagcaatgagagaaatggagagaaagggtcagatttgagaaatatttaggaaataaaactggcaggacttggtgatgaactcattagagaatgagtaaagaaagagggtgtaatagttgcgtagatatctgagcctatttgggcttctataacaaaataccagagactgggtaggttataaacaacagaaatgtatttttcactatactggaagctgagtaggtgaagataaaggtgttagccgacttggtgtctggtgaggatcgacttcctagttcatagatggtatcttctcactgtgcccttacgtgatggaagggggtgagctaactctctttttattagggtactaatcccattcatgagggctctgccctcatgacttagtcatctcccaaagtctccacctcctaataccatccccttgggggttaggattttaacatacgcattctgagtacacagaaacattcaggctgtagcactaagactgcaatatcaaagtaccacaaattgggtggcttagaacaagagaaatttattgtctcacagttctagagtctagaaatatgcagtcaaattgttttcagggccatgctccctctaagactctgggtagaagccttctttgtcttctggtggtaagagttgttccttgacttcccctgacttgtggctgcatcactccagtctctgcctctgtagtctcatggtgttttccctgtgtgtctctgtcttcatataaagataccagtcatattggattggggcccaccctactccagtattgcttcatcataaatgatcatatctgcaatgactttattttcaaataaggtcacattctgaggtacttggggttacaacttcaacttatctttttaggagacacaattcaacccataacagacaataaagtcaaaactgtgcttagtttactacctaagggtctataggatattgccactggtgagataggaaacacaggtataagagctagaagatgaattcgattttctaaaggacatacaggaagagctgttttaggaatcagttctacaggtttgaagtgcatctctttaagatagaaacaagctgttatgacttacgggtagcatcagtaattggcttcatgttttcatcgttgagaacatgagatgaaggttcacaaaagagttttatagcaactgttattctggcagcgctggtgatctctattttgagctgttatcctatcattctcagtaattttagaaccatcagtcgggaagtgttctttatcaaaactgagtcattttaataccaacccacaaaaataaaaactaaaaaaatttaaaaaaacatcgaatcattgtaataaacacctaaaccaccaacacaatagcttgaaaaagttgtcaaattttcttaagactaatatgggtaaatattgttttaatataaaaaataatagatgttagacattcagacatcctcaatttggaacaaacaatatattccctttttaaaaatattctttctcgatgtgttaacgtttacaactatagttaacatcttcattatgtgaataaacaaaataatcatagtttactattgttaacatcaattttatatttttaagaatgtttttaactttaaatattttaaatatttgatttagaaaatatcgtcacacaagtatgttccttttgtgcatctcattgaatttagtaccatctgtttgttttctaccaacttgaaatgcttcaaaatttatttgtccaaaactctaaaactatttttaattcctaattggatttttctcttaatgcaggaggtcttgctggagttgctagaacaatgtgtggatggcttatggaaggcagaacgttatgaaataatttctgagatttccaagttgatcgttccaatttatgagaaacgtcgtgagtttgaggtaggcaatttgaacatttttatcattgacttatgtattttattttggttttagggaaaacagtaatatagttctgtcactattattcgacttgtgtcctctgaagaatataaggttcattacattatgacttttgcattttatcatagagtatagtctatcattttgacacatttgtccaatttcaaagtgacaattcctaaaaatgctattaaatcctgagattttttaatgatttcaccacaaaggaatgataaatgtttgagatgatacatttactaattaccctgttttgatcattacacaatgttggcatgtatggaaacaacatttcccccataaattgtaccccataaatatgtacagttattatgtgtcaattaaagacaacataaaacttcctctggtcctgcttatgaaaataaagtaaaacttaaaacatcctaccttatattcatttatgttttccaaatgaaattaagggtaaaagatccaaaatagaaattgagatttaaattagaccagtggttctgaaaaaaaaaatttttttttgagatggagtctcgctctgttgcccaggctggagtgcagtggcgcaatcttggctcactgcaacctctgtctcccgagttcaagcagttctcctgcctcagccttcccagtagctgggattacaggcatgcaccaccacgccccgctatctttgtattattagtagagacggggtttcaccatgttgaccaggcttgtctcgaactcttgacctcaagtgatcctccggccttagcttctcaaagtgttgggattataggcgtgagccactgtgaccggcctgaaaatatttttatctagcaacctcccctcttcctctcagagcgtaaaataatcagtgttgttttcactaaaccttcacttcaaaaagctgtcaaatttccatgttacccagggaagaggcatagacatgattctattctttataatttagcggagaacctaaaggtgctggcaaatgacagtggggtaggtaataatacactagtaatacccctattatgagaattttaaaattttgacttgccagataaactattgataaagtttagttaataaagaatagtagtataatgcacagcaattgccaccagcactaaacaggattttttaaatattcaagtctcttagtccatatcataatttctgttgctactatgctgggaagggatgatttaggattcaagccattttaaaaaagcaaggcaatttattctttttttttgttttttattttatttatttagtttttttgagacggagtcttgctctttggcccaggccggactgcagtggcgctatctcggctcactgcaagctccacctcccgggttcacgccattctcctgcttcagcctcctgagtagctgggattacaggcgcccgccaccgcgcccgactaatatttttttgtatttttagtagaggcagggtttcacc[139 bp omitted]ttgacgtggtttctgagagtgaacacacatagatttaatataatctgagtagtgttttcatctctcctccaaactagctctgatcaaattcactttttcttcccagattctaggtcttcctctctctgccatacttttggtgtatatggggcatgcctgaaaactcatagtagaattcaagtgaatatattaataagctgaagtataggtcatacagatggcaaagaatagcctatgagacaaaaccagatttgccattacccctcctatcaaagcattacatctgaagaacctttgtagtaatttcaaaataaagtccccattttttgactcttaggatgaaggaagttctggctgttagaaacccagggagccttttgctacttagccaaccaacagggaagaaagaaaaatatatcttctttatacattaaaggaaatgatgttttctacaggggaactactcctatttccttggaggggtgtaagggtctgtataaatcccctagaactctgtatagatgaagtaattgtgtttaagactgatgtagctggagcatggtatacacgcctgtgattccggccacttgggagactgaggtaggaggattgcttaagtccaggagattgaggcttcagtgagctatgattgagacactgcactccagccttggctacagaacaagatccaatctcaaaacaaaaccaaaaagtagaacactgatgcatactttttcagtgtatctctatggaacgggctgaaaactatcagagatagcagccaaagtaaggaagatttccctccaattgagctcaattataaaagataatatgggaggaattttagagaaagaagcttgtgtgtttttccttttttgttgaggtgaaatttatataacatacaattaaccattttaaagtatagaaatcctattatcctatcattctcaatatgcacccaccacctctttctagttttaaaactttttcatctccccagaaaaacactccatacccattaagtaattactccccaccccactcccattttccaataaccactaacctgctttctggatttgcttattctggatatgtcatataaaaggaatacagattgagcctctctaatctgaaaattcgaaatcataaatgctcccaaatctgaaactgtttgagcatggtcatggtgctcagtggaaatgctcattggaacattttggatatcagattttcagattagacatgttcaattggtaagtccaatgcaaatatttcaaaatctcaaacacttctggtccaaagcatttcagataagggatactcagcctgtgatattatatgtgaccttttatgtctggcttctttcagttagcataatttttttttaattgagacagaatctcactctgtcatcgaggttggagtacaatggcatgatctcagctcaccgcaacctccgcctcctgggttcaagcaatcctcacacctcagcctcccaagtagctgggaggtgcacaccaccactcccggctaatttttgtatttttaatagagatggggtttcaccatgttgtc[142 bp omitted]acttcattcttttttatggctgagtaagattccattgtatggatatactgcagattgtttatccattcatccattgatggacatttgggttgtttcaccttttgtctattatgaatagtgctgttgtaaacattcatgtgcaagtttctgtgtggatatatattttcaattctcttgaatatatactagggagtagaattgctggatcatttggtaattctatgtttaactttttgaggacccacgaagctgttttccacagtggctgtaccgttttacatttcgatcatcagtgttctaggattcctattacttcatatccttaccaacattttttattttctgtttgttttattttgttttataaaatccatcctagtgcatgtgaagtggcacctcattgtcttggtttgcatttccttaatgacagtgagattgagtgtcttttcgtgtccttcttggctgcttgtacatctttggagcaatgtctattcaggtcatttgcccatttttaaaattggtttgcatatattttgttgttgagtggtaagaagtccttaaatattctgggtactaaacccttatcagatctgtgatttgcatatattttcttccattctgtagctcgtctttcacatttttgataatgttctttgcacaacgtgctctctttttctggaagtgcggaaaaacatatcctttggaaatatctgtgaacttgcataaaagcagtcctcactgcagcttacaccattgcttatttttatatttgcattttattttcctttttaaatacatggattgtttattctcatagctctctacctgagggctcaagcaaagcatttggctgccctttcagttaaaaatattccgatcctgtagaaaatagtagttgataatacagtatttcaaaatttaaaatttccattgagatgtgaatgaaatgaagcatgatattaagaaatacattgtcattgaggaacagaaaaccacataccgcgtgttctcactcaagtgggagctgaacaatgagaacccatggacacagagaggggaacaactcacacagggcttgttgtggggtggggggtgaggggagggaacttagaggatgggccaataggtgcagcaaaccacgatgacacacatctatctatgtaacaaacctgcatattctgcacatgtatccccccttttttttttagaagaaatttcttttaaaaagaaatacagtgttattttaccattttaagttctacccttagacctaaagttgttgaggactttgattgttacaaagggagatgagtatgaatggccccaccaagaccattttgaaaagaatatactggtgctttttatttttgtacattcatcttgaagacatttagtaattaaacaaaaaacaaagctgatttgtatatttttatttttcagaaacttactcaagtttatagaactcttcatggagcttacacaaaaattctggaagttatgcatacaaaaaagagacttttaggcactttcttcagagttgccttttatggccaagtaagtgtacttgaatccataaagttttcctttttaaacattcacctttgaattactagtttactatagcagctaggagtctatccagatagagtgcctattacaacagcagggagcctcttttgtatgtataaagttcactttggttctcatatctaaacccttcaggtcagaatacaacagaaaaggttttgatttctgtcagtttcattttctgttaagctttttaaagtacatattaaatatatagtagttaaaacttttaaataaaaaacaggtaagtgtacagggaaggaaaaaacctagtttggaaatcttcctcaggccatatgtttatgtgattataaatttgaaaattaccaggaatttaaaaattctcatgtatttgaaattaaaagggtaaatacaagcatgggacttttagtaatattattcaaaatttatttcaaatatattattactagttatttagtagattttctttaaatgttgtgtttgctcatattatttataagttattatttgtttaactttataatagtctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaacacataccctacatgttgaaatcattatttgttagttccaggcattgtacattgctcctgactttttccttttttaactggtagagaagcatgaaaacagagctttccagataataaaagaaagaacaggggctttggagtcagagataccaagcttcaaatctctactctctgccactcactagctgtgtgaccatggggaaggtacttaactctctgtgcttcatcgttcttagtaataaaatggagataataatagtagtattttcctcatgaggttgttgtatggattaaatgagttaatatatggaaagtataatcactttcctggtacataaaaagcattcactaataatagcaagctagcatgctcactaaaggttagatattattgtaaatgctattgtacatcatgattctccgttacatcatgattaaaatcaccttggggcacacattttattctaagatatccttagttcagtaatagtgactgtagttaacatttgcaatgaaataggtttaggagagatccttgagccttgctctaaaggttatccatcccactaggccctgccaaggcatagtgagaaggcttatattatagcaagagaggccctttcctaggaaatgcatagttccctatagacaggatttgggggaagcactgtaggaatgcctgactgtccttagttgccttgggtgtgcccagacttagagctgatttttaagggtaggaagctcatataaagttcaagatttgtatccacagtgatatttactgagtgactatgatatgcgcagtgctatgcagaacacttaaaagctagcaggaagcattaccagagtgaaaaagcccatggctattgtaaagacacttcattgtctaccacgaaaataatctcttcactttgtatacttacatatatctcttggagatgactttatcttaaacacatgcctaagacatttaaaaatagatttggtggtagtttcaacgtaatatatggcaaacactctctacttctttccttatcagtttcactattttgtgttgtttcgttgaattgagacaacagaagattttctccccttgcagccagatagtgtaagacttgttcccacaatattgattactgtataaatggaaaggtaatgaaaagtcagactttctgtgcaacatgcagttttctaccttattctgcctctgaaaactgggccaaagaatgctagcgacaaaccactacaggtggctggactcctgatgtttgttatgtatcatattttagtagttccccacaggcaacagacataataagcagttctggcttttaaaatatatttattgttttctcagtttgtgaaaataaaaattaaaaatattcttttcccttgccaaagaacaaaatctgcttaagggcaaaggcaatttgaagaggagtttggcaatatcttccaatattttaaatgtatgtgtccttggacccaacaatttcacatttaacattttatcttgtagatgtacacatataaatgtatatgtttaaagttgttcactgccacaaaatttatatagcaaaaacctggaagcagtctaaatgtccatatggttaaagaaatggcggtattacccatataatggatataaccacctagacattaaaaagcatgagagatttgtaagtgtccatatgaatctatcaagatgtatatttttttcttttctttttattttattttatttttttttagacagagtcttgctctgtcacccaggctggagtgcattggtgccatcttggcttactgcaacctccgcctcctgggtttaagcaattctcccacctcagcctccctaatagctgggattacagtcgctcaccaccacacctggctaatttttgtatttttagtagagctggggttccaccatgttggccaggatggtctcgaactcctaacctcaagtgatccacccacctcagcctcccaaagtgctgggattacaggcctgagccaccacgcctggccgcttttaatttttttcgagacagggtctggctctgtcgcccaggctggagtgctgtggcacgatcacagctcacggcagccttgacctcctgtgctcaagcgatcctcccacctcagcctcttgagtagctgggactacaggtgtgcaccaccacacctggcttatttttgtttcttgtggggtttttgtgtgtgtgtgtgtggagacggggtctcactatgttgcccaggctggtctcaaactcctgggttcaagcaatcctcctgtcttagcctcctgaataggtgggactacaggtgtgttaccaccataccccagctaatttttttatgtttcttagagacagggtcttgctatgttgcccaagctggtctcaatctcctgcgctcaagcaatcctcctgtcttggcctcccaagccctcagattacaggcatgaaccactgcaactggccccatgtaaatcttttaactaagcaatttcttttctaggaatttatcctaaggaaaaaatcagaaaaaaaatgcacacagttttaaatacaaggatgttcatcagaacattatttacaacagcaaaaagttggaaaacagcctgtctccactaatgagagaatggtccaataagtcatgtttatccatacagccattaaaagtaatgtcagtgactatagtataaactattggccagacatggtggctcatgcctataatcccaacactagggggctgaggcaggaggatcacttgtgcccaggagttccaagctagcctcagcaacacagggagacctcatttctacaaaaaaatttaaaaattagccaggtatggtagtgcatgtctatggtcccagctacacgggaagctgaagtgggaggatcacttgagcccaggaggctgaggctgcagtgagacatgatcacaccactgcacttgagcctgggcaacagagcgagactccatctcaaaaataaataaataaactatgatacctgtgtttttattgaggtgtaattcacataatgcacaatcaaaactgtttagtctgacctcaattttctgaatacataggcatagaagaaagatgagaaggaaatatataaaaatgtgaataatgatcattgctgggtagtaggattacagtaatttttttttttttttttttttttttggagacagagtttcactttgtcgcccagactggagttcagtggcgcgatctcggctcactgcaacctccgcctcccaagctcaagtgattctcctgcctcagcctcctgagtagctgggactacaggctcatgccaccccgcctggctaatttttgtgtttttagtagagacaaggtttcaccatgttggccaggctggtctcaaacccctgacctcaagtgatccgcccgcctcggcctcttaaaatgctgggattacaggcatgagccaccgtgcctggccaattacagtaatttttaatttcttcgtatgtttctgtagtctccaaatagatttctgtaacttctttataatcagaagtaagtgatttttaaaaagaagaatgaagacgccctttattggaaacacaattataatggcaatgttcctcacttggtctcaaagaagttagtaggttaccttatctccttttcccttccactgaataaaataaaaaataaaataaaataaataaataaaaactttcttattttataggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaagtaagtacaattttacatattaacttcttatttgtcttggtctttttcagcatacacgagtagcagctggccagctggaacatacaactgaaattttaattattatttgttctgctgttcagttacaagtttgcacaagcacgtccatgtgataaaccatcattttcccatatgtcatccatgattgcccagaggtgtctcataaagagaatttctctctgaatcctgaagtactatatgggaccctaagtcatcttctagataaaggatggggagagttaagcacaatagagttttttctttaatttggctgtttgaacaaatgattttctaaagtcagtaaatcaatcttaacattttaatagcttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtacgttggtcatccaacatgtattgaatgtttcttgatgtttcttttggttttataagggcacagagcaagcattaattgtaattatgtgttgggcacttactgagtgcaaaaacctgtgcattattttttgttcatttaatgaagatattacattgaattttttaaagttttgtgttatgtcagaggactttaacataagtccgatgactgtagcgaagccctgtatgtacatatcagaaatcactaacttactagaatatcatctttgtagattattttctttagttaatggttttttgaaataaacttgaaataagcatatatttctcagatatggatttcttgtatattttgggatttttaataaaaaagagaaatgccaaaacttcttttgattattgcattctggaaacactctcatttttcttctattgtgatataggtcaatgctggtccattagcatatgcaagagctttcttaaatgacagccaagctagcaagtatccacctaagaaagtgagtgagttgaaagacatgtttaggtaagtgttttatagttttcaggttagacccgtgttcgttttctctattttcttcttttaaaaaacaacaaagtattgaccaaataatacccttccaaaaagggacattctctgtggtcttttacaatatctaagtgacctcctaatggcactttgagcaaatgtgagatcagtttcatcctgcaggacattaacaataccctagtgacccaagagattaaatatgccagtttactatattgctttgaatattttaagtgacacaaacacaagcctatgttccttatgtgctttccttcttcacccaattgacctcctgttacagcatttcagaccatttggggtaggaatagaagtggggcaggaaagattgcataggctcactccagtcccctgtccttacttctacttggactctgccaaactagggcatgcaacatcttgtcttcagtgagcggctctgtaagcttaggcatgtatgaatgctcctacattagagaaatatctttaatatataaaagtcttcattcagaagaagagaaacagttgagtaatatggactaaggagaaagatgataatctatccactcatttgctcccgacttattttgtttacttttcctgtctatgttttatcagctgttccagagtgcagagtaaccagtagtcattcattcaccagtattaatgcctggtacatgcaaaagactatttgttgctatgacagggatataaaacaaatggacaatgaagtactttgtcccctaagacctacactctaattgtggacattaaacataaacacatgaaataatggaaaaagacttttatgataggtcatcaactttctgttctccttcctagcagcccagggaagatccttcatacctgtaccacccagcactgtactagccacatagtaagctcaaaataaattctttttgaatgaatgactcgttatttataggtgcaaattaatgtcagcacaactttagctgatagaatgccaaggaaatgattgagcaagtaggctttccagagggtatgtgttttgagccaagtcttgaaggagataagaaatgaaaccataaggcaaaggtggaaaggaaagaaggcatttcagacttaggaagagacattaagaaataaatgcacagtgagaaaatagaggattctgatcttcttcctaggcaagccatggctaaactgagttatcaaatggattgtcagtgatacttcctaagaataaataacaagacctttatctttgatattcatccacaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattagggtgactaaaactgaaaacatgatctgcgggtcccaaaattgttgcttagcaaaatataatggttcaaaatgcacaaccttaaagttattaagtctatattttaaacttttttcatattatctttaatcatttaagtgatacaatacaaatcaaatttgcaacaattatctaaagtggttagtgatgcagttatctgtaagaaaccattttgttttttgtgctccagtgtcagaggcaagaggttgaactgaggtataccgttatcaaatagattacatagtttgtttttagaaactatctagttgatgagtttctattcctcataatgcatagaaaaagcagcaaaaattcctccttcacaaaagatatgacaattgcacatgctattttaagtgagtatctactatattacagttatttcatttgcatgcagctgcatgacctagtgttgaactctaaattattcaaattgaaaacaaattattcaatgtactgttattactgtaatcaagatattctgagtggtcattttataaaattttgttttccttttgaagcatggatttttcaaatctactgtcgtatttcccacttgtctgtatcagttattcccataaaacatggctatttctcttagatatagagaccaataatttagactcttaatattgtatattgatagctaaccaagaaaactcttagtttctattggcttatatttatgcaagccatcctgtcattatgaaacatatttgggtgtgccttacttttggcaaatgttgactttgtagtgaattgagtttcacataaaagagagccaccttgtagtcatacactttgaggcatatattaatactgagaagtaagacaagtgttaatgtgtactgaaatttgaaatattctcttgagctccataaatgattacttgacaaaaagacatgactggatattccttgtcccctttcagtgtaatctgttacagaataccgaagtatatagtcctttcaaaaacttcttcaagcttttttttcttttttttttcttttttttttttttttttgagagggagtctcactctgtcgcccaggctggagtgcagtggcacaatgtcagctcactgcaacctccgcctcccggattcaagtgatttctcctgcctcagcctcccaagtagctgggactacaggcacgtgccaccacgcctggctaatttttttgtatttttagtagagatggggatttcaccatgttagccaggatggtgtcgatctcctgacctcgtaatccacccgcctcggcctccaaaagtggtgggattacaggcgtgagccaccacgcctggctgcttttgatttttaaaaggatttatattatcataaagctataaattacagatttctcagatagagttgggggtggtcattgtagcatctgttgggtatgttttgtaatttcttagcaataagtaccctccttgcctgtcacatctgaccagcatagataatcagttattcatctcttaacattctagtatgctttcagattagtgtcatgagttaatatttttgtaagaggaaatttctctattataaattttatttaagccttatgatttgtagcaacacaaatgatatgtctcaatactgccactatagatcaatctgtgggcttaatactgaagtttcacaactaacttgagaaccaagtattgaaagcttgggacctaagttaggactttatggtaaagagagtggatataatgtatatagcgttttttacctcaatctactttaagcacaagatttctgttgctttttctttagattacacaaaatggatcatttaaaaaatatttaaactaatacgaatatctatgtttatatacttactggaatacaatctttaaattttatatttatgaagttcttcctttccaagaaaaatcttctgtatcaattagcttatacaattataatgtgtctttagaaatatgcacttaagacttttatcttcatttactattattttcaagtctccagggaaggaacataggtatctgcatgtttcaaaagtcccatagatgattctgagaaccactgtgttagatcattcataaactcatgtcagagtctaccatttagagctcttgttatgaccatctgttaaaaaatattttaaagattgtgttacctctcgctttttattgaattttgcattttacagtctttgtttttcttaatgagtaactagatcttttctgcttttttgatatgctgcctttgtaatacagctttgaagacttaagtcggtaatgttattctttgctctctctgctttctgtctttttaaataactgtcagtgataaattgaaatatgcctgcaatttcatatacacattctttttttggcagtggctattttgcttcatgataatcatgctgatttcttctgttttagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaataatactttgaacttagcatttttcttgacaagaagctcaattcattatcatactaatccttggtaggaggagaagaaaattgataacatttccgtaatacacggatatttaaaattggggagatcatttgaatccttgccaattagtagtcaaggctgggctaaaggaaccaaaagcattatttcacagaaaatttcaaaaggaaaggatatatttacaaatatacgaagcttaggctggacacggtggctcatgcctgtaatcccaacactttgggaggctgaggcaggcggatcatgaggtcaggagttcaagaccagcctgaccaacatggtgaaaccccatctctactaaaaatacaaaaattagctggtcatggtggtgcatgcctgtaatcccagctactgaggaggttgaggcaggagaatcgcttgaacccaggaggtggaggttgcagtgagctgagatcacgccactgcactccagtctgggcgacagtgagactctgtatatataacatatatataatagtaagcttgagataccatatatatatgttatgatctgatgacgctaggtaatctagtaggtctcccttctacatacaagacatctaagggatttatacagggcaagcagcatttgttgccaaagctttatcatctggggccatctacaaagataaaacatttctgagattgcagtcagtacatcccacagaacttcaaagcttttacagcaatctgaggtaggagttttgtaatgattattttcttcagttacaagattaataaacattttgattagaacttaatggttgcagcatgtcttgggtcaatgtagaaaaccaccacagatttggcaaactagcttgggattatatttctgtctatgaagaaatctcagattgcctaaataattcaggagaaaccaagatgtgaatgacattttttagcttgaattatccaaatcattttggctgccttctatgggaactcgggttctagacttccttttttttttttttttgagatggagtctcgttctgtcgcccaggctggcgtacaatggcgcgatcttggctcactgcaacctctgcctccctggttcacgccattctcctgcctcagcctcccgagtagttgagactacaggcgcctgccaccacgcccggctaattttttgtattttttttttagtagagacggggtttcactgtgttagccaggatggtctcgatctcctgacatcgtgatctgccaaaagtgctgggattacaggcatgagccactttgcccagcctacacttattttccttatgtggtttagcctcttttacagatgaaaaaacagtcactaaaatataaatggattgcacggggccttggctttttgagcactttgtgatcaagtaaatcctagagattatgctcctggcctgaccatttttatttttattttttggggggtaccattttttcttttttgagacaaagtcttgctctgtcacccaggctggagtgcagtggcgccatcttggctcactgcaacctccatctcccgggttcaaatgattctcctgcctc[134 bp omitted]gcctcccaaagtactgggattacaggcgtgagccaccgcgtccagcccattttttctttatatgtcatttttaagctttcaggagagcatgaacttatttattaaaagttaattttgtattttaataggggacttttacaagtatttccaaggcagtttgtaattccttaatatcttagagtaacctgtagagttagtttcacctttaaagtgattatatttgatatgtatgtgtgaggaatcatcacctctagtaaatgctgcattctgagagtttggcatcttgaggagactccagcactcttctgtctgtaactagtccctgtcaaagcccctagcacagcaatatgcactgtgggtagattttttaatgtaataaatggcccctattgccaaggatctcgcagtctagttgagaaagcaagacgcacaaaattaaatagtacaagaattaacaatgtaagacaggagaagtcatatgtgagtattgccaaatgaacgacagcattcataactcaaatcacattcaaagaaagagatcactgtgaattgtaaatgttcagggagggtttagtgaagaaaagttaagctttgaacaggcttccaaaaatggagaggggtattctaggcaggaggaacaccataagcaaaggtgcaaaaagaatttgtggaggttcaggggatagtaaggagaccagttttgtccaagaggtggtagatgataaatctagaaaatacaggctgggcgtggtggctcatgcctgtaatcccagcactttgggaggctgagacaggcagatcacttgagcccaggagttcaagaccagcttggccaacatggtaaaacactgtctctaataaaaatacaaaaaaaagttagccaggcatggtggtacacacctgtaatcccagctacttgggaggctgaggcacaagaatcgcttgaacccgggaggtggaggttgtagtgagcctagatcatgccattgcactccagcctgggtggcagagtgagattctgtcaacaacaacaacaacaacaacaacaaaaagaaagaaaaaagaaataaaatacattcggactgagattttggaaggcgctgaataccaggctaatggtatttggagtttactcaataggcatgagagagctagccaaggtttttaaacagattacttaattaaatgttatttttagaaatttaatcttttatattgctgccagatgtatttgaggtagagagacatggaaattaggaaaccagttacatagatattgcaataaactaaattcaataaacctctagatgtgagtgatatgacaagaatggagaagaaaggacgagtcccagagacatatatggaaggactaggtaagactcattggatggccaagggaaaaaaaaaaagaaatgtgaaagataattttgtgtcctgtggccagggagtttgccatgtcatggcacaagctcactagatttatttttccaactctcagactaaaggtagcaagctgtagagaacaaggtgggctcgaacagagaaagctaggtaaatctgttttttaaacactacatgtattaggcattaaagtgtatatagtttaatgatttcttgaagtgatttgtcctctacaaattaattaacaccaaagaatacatttctcctatactgattgttttgcagttaagcttgagtccaatttcccctagaagttgttgttttgatagtctttggacatactgtgaaatgtgattaagtcacccttggtagtgttagtttatcactacggtgaaaaaccatagagaaaataagaaattccatggaaattttcctagtaaccagttgtcaccactggcatcatgtatatagatgggattgttattgttaccgtatttatatgatttggctgcctatcaaaatattatatattttcaaaagtgaaacagaaagcagcagtggtagtaatgtccttggaaccttgaccaacaacacatcatcctagaactagagatgactctaattaagaaactagataagtcatgataataagaacgcacatttttaaaaaactatttcgtatctttttttcttctaacttttaggttcagggggtacatgtgcaggtttgttccatgagatattagctttctctgagatgaagaacctgagtgatataatggattaataggaatttccaaactcttcaaaacattgataattagacatatgtcttgggcttctgatctccaaaatgttgggctacctttagtctcagtcttgttctaacagtacactagttcagctatcaaaagacaaggagaggaaaggagtaaaagttggttgtgggtggggagtgggtttgtgtaacaaggctatacccctgtcttgggagttggtgagtaagagtgctttatttatcttttttttttttttctaagcacttaatggtcactgtctaaaaacagtgtatctatgtttgttcatctcctaatgggagtcgtggctaagttctaagattttgcctctgtgcatagcattttaaaacttttccaatgttctttttttttgctttgtttttcctttttattgagatataattcacataccatacaatttacccatttaaagtacacaattcagtgttttttaaaattacatccacagagttgtgcaagtatcactacaatttaaaacatgtttatcacctgaaagagaccccatactcattagcagtcactcctaccggtcatcatcctccagcccctggcaaccactaatctactttttgtccctacaaggtttacctgttctggacatttcatataaatgcagtcatacaatatgtggccttttgtgtccagcttctttgacatagcatatttccaaagttcatcgatgttgtagaatgtatcagtacttcattcctttttatggctaaataataatccattatatagatacaccatattttatcttctcatcagttgatggacatttgggttatttccactttttggctactgtgaataatgttgctgtgaacactcacaagtttttgtgtggacatgtttttagttctcttgggcatgtacacagaagtggaatgactggttcatatggtaactccatgtttaaccttttgaagaattgccagactgatttccacggcagctgcaccactttatattaccaccagcaatgtatgagggtcccagtttctcaatattcttgacaacacttgttattatctgcctctttgattattgccatcctagcaagtgtgtagtatctctttgtggttttcatttgaatttccctgatgtctaatgatgttgagaattctttcatgtggttactggccatttttgtatcttcctcagagaaatatctcttttaagtccttagaccatttgcttttttgagacagggtcttgctgtgttgcccaggctggagtgcagtggtgcgatctcagctcactgcaaccttcccatcccgggctcaagcgatcctcccttttcagcttcccaagtagctgggactacagatgaacaccaccacacctggctaatttctgtagaattggggtttcgccatgtttcccaggctggtcccgaattcctggcctcaagcaatccacccaccttggcctcccaaagtgctgggattacaggtataagtcaccgttcccagccccttagcccatttttaaatcaggttgctttactattattactattattgttgagttgcagggttctttattcgagatgcaagtatatgatttaaacatatttctcctgttctgtgtgttgccttttcactttcatgatggtgttctttgaagcattcaagtttttaaaaattttgatgcagtccaatttatattttcttttgttgcctgtgctttggcattgtatctaagaagaccttgcgtaatccaatttcacagaaatttacacctatgttttctcttaagagttttataatcttaactcttacttttggtctttggtccattttgagctaattttgtatatggtgtgttgtagggattcagattcattcttttgcatgtggataaccagttttccctgcaccatttgttgaaaagaatctttcccccatccaattgccttggcacccttataaaaaatcaattgaccaaaaatatgtgggtttattctggactcttagttctattctattgacctctgtatctgtccttacgctagtgccacaaagtcttaattactatagctttgtagtaagattttgaaatttggaagtgtgagtcctccaactttattctttttcaaaattgttttgtatattctaggcccctcgcatttccatttttattttattttatcttatttttttgagacggagtctcactctgtcctccaggctggagtatagttgcacgatctcgggtcactgcaacctccacctcttgggttcaagtgattctcctgcctcagcctcctgagtagctgggattacaggaacatgccaccatgcctggttaatttttgtatttttggtagtggtgggatttcaccatgttggccaggctggtctcgaactcttgacctcaagtgatccaccctcctcggcctctcaaagtactaggattacaggcatgagccacacgcccaggcccatattaattttagcatcagctag[141 bp omitted]aaacctcgtctctactaaaaatacaaaaaaaattagccgggcgtggtggcaggtgcctgtagtcccagctactcgggagactgaggcaggaaaatggcgtgaaggtgggaggcggagtttacagtgagccgagattgcaccactgtactccagcctgggcaacaaagcaagactccatctcaaaaaaaaaaaaaaaaaaaaaaatggccgctgggattttggcaggatttgctgtgaatctgtaattcaatgtgcagagtattgccatctcaataataataagtgttccagcccccatgaaataggatgtttttctatttatttagatcatctttaatttctttcaacaatgttttacagttttcagtatataagtcttacacttcttttgtttattccttatgcccacaaggaagtttattccttagtattttatcctttttaatgctattgtaaatggatttgttttcttttcttttctatttatttatttatttatttatttagtgagatggagtttcgctgctgtggcccaagctggagtgcaatggcgcgatcttagctcactgcaacctctgcctcccgggttcaagcgattctcctgcctcagcctcccaagtagctgggattacaggcccatggcaccacacctggctaatttttttgtatttttagtagaaacggggtttcaccatgttagccaggctggtctcaaactcctgacctcacgtgatccagctgcctcagcctcccaaagtgctgggattacaggcatgagccactgcgcccggcctgatttgttttcttaattttatttttggattgttcattgctagtttatagaaatacaaatggtctttgtatattgatctgatatcccaaaatcttgctgaatttctgtattagctttaatcgtgtttttggtggcttctttaggtttttctatacataagatcatatcatctgcagatatagttttacttctttttaaatcttgatgtcttttattttattttgttacctagaacctagctagaacttcctgtataatattgagtagcagaattgcagatagccttgtcttgttcctgatctttgggagaaagctttcagtctttcacctttcagtatggtgttacctgtgggttttttatggatgctttttatctggttcaggaagtttcctccaacatgttttgcatctattttctgatccaattctccttatatatgtcatataggaatcaattcttcatgtgatcctgtatcacatataaggaaatggatgcataaatggttaagaaatgcactcaagacacgcaggaaattagagatgaggtcacggtatcctgatttatagtctattgttttcaactctactttttcctttggtcttctgcttcaacttcttgcaactttctagagactaaaaagggttcatcttttccactttttcatttaaaaggtaacctccatatgggtagagtctggatctgaacttttccacctctgttttcccagaacctagcacaggataagtgcttgagcagtctcaaggaaataaagccagtttagataaacagcacccctggagcctttattatgtgcaaggtattgtgggcagatatcccagaactcggagagactgtggttgagggagataacaaatagtcacattaaaaagatattatgggccgggcatggtggctcatgcctataatcccagcactttgggaggccgaggcaggtagatcacctaaggtcaggagtttgagaccaacctggccaacatggtgaaaccccatctctactaaaaatacaaaaagttagccaagcctggtggcacgcctgtaattccagctactggggtggggggtgcgggggtgggggagggctgagacaggtgaatcgcttgaacctgggaggcggaggttgcagtaagccgagatcgcacaactgcactccaccctgggcaacagagcaagactcggtctcaaagtattatgaagaagtctgataatagcaaatcagtggtagttacaagtgcttgaaaaggcagagtctttatagatgtagactgaaaaaggcttcatggaggaaatgccatgaatttttctcatttttattagaactgccactagcgtgtctgtgttgaggaagtactttaggccaagtttttaacaggaagtttaaaaaattaacttctttatttttatcattatatgaattccaacaattaaaaccatccgtagtacacaatatgcaaagcaaaaataataaagtgcatataaaatcaggtaacattctttatatgttttttctcagactctctcatcctgttttggtcttagacacaagccaagttaaatcagctttttctttttgtccagaaaacttatgctcaattttcttcatcctcttgatagaaaacctttacagccaacctcagtcaatttctgatcgacaagtctcattctttatataccatagtgttttgtaatagtcattactttagtagatctcctagaattgagtcttacaggctctagacttctcatcctgcatgcttactgcatgtgcctttcatagaaaatcagtgaaaactatcatatgagcaggtaaaggctgcagtgtggaagctgtagaccattcattcatccatcacacatttattgaccacccactgtgaaccaggtatatgaatgatcaaggcaatatttcacaggcagataatgcagatgggatgttataatctaaaagataattcaaaagtagtcttcttctgtcaataacgaatcttccaaattctgtattcttgaagagagacatcttatgtctctgatgaatgtgagtaatagttcctagtactgatatattgtaacaattaatatgttgattgagaagcaaaagctaagccattatagatgtggaattatgttcaatgcaaagctgaccagctcctatagtactcatgcagtgggttatttcagaattcttctgtggcatagtcaggatttgagataccttcagagccacgatgatatcatgtaatagtactatgtcctccctccccatcccaaactaaatctagacacaaatacacatgcaatgaaagaggattagagagaaagaaaggtggagttgacaaaattatccctatcagaacaaggaaaatgaaaatgaagccgggcatggtggcttactcctgtaattccggcactggggaggtcaaggtgggaggatcacatgagcccaggagtttgagaccaacctgggcaacatggcgaaaccacctctctactaaaaatacaaaaaatcagccaggtgtggaggcatgcacctgtagtcccagctactcaggaggctgaagtgggaaggaaacttgagcctgggaggcagaggttgcagtgagccaagattatgccactgcactccagcctgggtgacagagtaagaccctgtctaaaaaaagaataataatcataaagaaaatgaaagacttccagaagaaagcattgctgcagtttgttccacagcaactcccaagtagtcacagagccagctgaatacagttcaggtcacatgtaagagaatttttaaaaatgtacccacattatttgtacaaacttgtagggtacatgtgaaattttgttacatgtatgtaatgcatagtgatcaagtcagggtgtttaaggtgtccatctcccaagtacatttttgttttaactgtagtcaccctattctgctatcaaacattgaatttattccgtctatctaactgtaccctttaacccacttctcttcatcctcctttctgaagagaaattttcatggaaatgattttggatatttacacagaatgttttattttttaaaacaaagtaacctctctaaccaccaccacctcttctttgttgtagaaacaaaactcagaattgaagttttagccctggaatatcttcaggaggggaaattccagctctccccattggtttaaccatcttgtgatttttctcatttttattagaactgccactaccgtgatggcctccaagtttatttcattatagctctgtgacgctagatgagactgttgggttggggggatgctgccgggggaggggggtagttaggggtacccatacctacctgggtgttttggctgctctccctctaatgattattctcatcttgagagttttggcatccctactgtacagcacatttgttaagtatacaaattctgaagcaggttgactgggtcagaatcccagttttgtcatttaccaagctgtgggaccttggtcacattacttaacccctctaggtcttcatttcctcacctgtaaaatgcaggtatgaattgtccctacctcctaacatcgtgaggattcaatgaagccaagtatataaagcatagagaatgatgcctggactgggcatggtggtgtgtgcctttaaccctagcactctggaaggctgaggtggaaggatcactcctggaagagcccaggagtttgaggctgcagtgagctatcgtgccactgcacttcagcctgggtgacaaaagcgagactctgtcactaaaaatataaaaataatttttttaaaaaaggaatgctgcctggcacatctacgtaattgttacatctatatatgtgttatttataactgtaatctttcccccacagcataggataattttaccagccatgataccctctgtgtctctgggcccatccctccatccaggtaggggtaatggatgggtcaaggtcaggcaatttttgccatttgatatcttacaggtcacctctggcctccgttgatctcaccatatggtgaagatctgttcccccatgaagggacattgttttctgtgtggtggtataagtaccaacaaatatacacagatgctggctgttagcaactagtactgccatactggcgcatcttggctgaatatcagccctgctcctgtgtctgtctttttttttcttttcttttctttctttcttttttttttttttttttttttttttttttgagatggagtctcgctctgtcggccaggctggagtgcagtggtgcgatctcggttcactgcaacctccgccttctgggttcaagtgattctcgtgcctcagcctcccaaatagctgggactacaggtgcacgccaccacgcccagctaatttttgtaattttagtagaaatggggtttcaccatg[136 bp omitted]tatggctttcttgtgcatctgaggattgatgaaaattcccatgtgccacctaactataggatttctctgcttactggcacttcctttggctttgttacactaccagaactacacagaaagtggttttggatttgaaattcaactagtgggacttgctcagtattccctccatagagagcctctcatacacagtctcctacagttaagtttaatttattcccctcatttggatttccctgtcactggtcacagattgctattttatggctctcaagtagatcagaaaggttttcagagttccccttccccacctcctacccacttctctgtaacgacagacaccctttaagggaaacttggcccaaccaatattatttgaagacatttcattctcacttaggtaatggggcttggagttgaggtctacctttttgttgctttctagtaaagcactgacccctatctcacagtactctcctaagccctgtcctccctgacaacttagttgctttatctttccaggagcaccctcacattcctatattgtgcacactcaagacaatttcccagtgtccacttcctggctgaatcaatttccacaaccatgacgtgtaactccagctcatctcaccaaagggcattttagcaagtcactgcagatgctgcaactcggaaaaacacgtttagttaggatctgatgagtcttctccattagataaatgttgtgaggtggaacttactgtaatttccttctctccacccaagatctaaaatttttctctgagttggctccctctctaccttcagtctcccttcctggaagatttaccccagcaaggatgtcttctttcagatggatatgagtaagttagtttctgccctcgttctgtttcttccttctcctgctctgatgttggcacatccttaggaagtcagctactccaccccctctaccaagatgtggcccaatgagggtagggtatctttcacttcccctttctgggaggccgactggccaagactgaactacctagacccccccacccttaccactgtcattctactcactgaccccacatgctcattttttggttgtttgctccactgtccctgagatcttagaggaggggttcttaactgggggtggttttaccccctagggaacatttagcaatgcctggagacatttttggttgtcacaactggggcaaagaggttgccactgacacctagtgggtagaggccagggatgctgttaaacatcctactatgcacagctagcctcctacaacaaaaactcacctggctcctgctatcaatagtgcagatgttgaaaaacactggctagaaggaatgcctgcctcactggaatgtgtgatgcctactccaccgctggtttgtcttcaaggagccttttgctggtcaactcaccaataaatccactaggagatctctcccattaatagctgtttgtaccctcatttacatctgtctgccccctcacatgtttgcatgccacaagtaatggtggtctgctcaaccttcattcctaactctgcacttcatctgcaggttggccatactcaagaacctgaaggtgctcaggatctgcttcatgatctccgtggctatccctttcactttccggtgaagtaaaggctttctcattactagaaaccatccaagttaactaggccatacaattacaatgtcattgctactaccacctatgaagcagtatagtttatttaataaaacaaaacctaagacctctaagttattagccctgaaggagaagcagtaagtcgggaggacttgtctactgaaggacaaaaacaaactcccaaatcaatggagagacatattttgttagaattataaatatgtgacttctctccttaatatctgtcaattcaatgccaccttagtcaaaatcccagaaggattattattattattattattattattattattattattattattattttgagatggagttttgctctcttgcccaggctggagtgcagtggcacgatcttggctcactgcaacctccgactcctggtttcaagcgattctcctgcctcagcctccccagtagctgggattataggtgcaacacgcccggctaatttttgtatttttagtagagacagtgtt[133 bp omitted]ttataaaatttatcagaagcacctgaagtcccagctactcaggaggccaaggtggaaggattgctggaggccaagagttcaagactatcctgggcaacatagcaagactctgtctcaaaaaaaggaaaattgaaataaaaaataaaatttatcagaaggaatcaagatgtaaaaacagctaagaaaataccaaagaagaggagtaaggagccctggcagacattaaaatgaataatgtagctaattaaaattgaacattttacccataaaaattaaacctaaaaataaattggacatttactaatagagaaataggcagaaggatgtaataggacacagaatctgtatgtatataaaaatgtgtatgataaacgttggatttctgccgggcgcagtggctcacacccgtaatcccagcactttgggaggccaaggtgggtggatcacctgaggtcaggagttcgaaaccagctaacatggggaaaccccatctctactaaaaatactaaaaattagctgggcatggtgacacaagcctgtaatctcagctactccggaggctgaggcaggagaatcgcttgaacccaggaggtggaggttgcagtgagccaagatcgtgccattgcactccagcctgggcaacaagaacaaaacttggtctcaaaaaaaaaaaaaaaaaaaaaagttgtatttcaagaaataacagtgtcaagatcattcaataaatggtgttggaataattaggtaagcatttgcaccttttttttttttttttgagacggagtctcgctctgttgcccaggctggagtgcagtggcacaatcttggctcactgcaacctccacctcctaagttcaagcgattctcctgcctcagcctcctcagtagctgggattacaggtgcgtgataccacacttggttaatttttgtattttttagtagagatggggtctcaccatgttggccaagctggtctggaactcccgacttcaaatgatccacccgccttcgcctcccaaagtgctgaggttacaggcatgagccattgcacccggccttatgcacaaaatttaagggctctctatttacacaaaaataaatttcaaattgattagagatttaaatgtaaaagacaagatcctttaaaaactaaaactgggcatagattattatatgtgcagtagaggtgaggaaagtctttctaaagaagacttaaaaaccagaagtcaaaaggaaaagcaattaatacatttgatcatataaaatttaaatttaaaaagattataggctgggcatggtggctcacacctgtagtcccagcactttgggaggctacggtgggaggatcatctgaggctagttcgagaccagtctggccaacatggtgaaacccagtctttactaaaaatacaaaaattagctggacacagtggcatgtgcctgtagtctcagctactcaggaggctgaggcaggagatt[135 bp omitted]atttgtagtatacatgataggataaggataaatattcttactataaaaagagctcttacaaatcaataagatgaaatttctcaataagaaaacgggtaggctgggtgcagtggctcacacccgtaatcccagcactttgggaggctgaggtgggtggatcacctgaggtcaggagttcgaaaccagctaacatggggaaaacccatctctactaaaaatactaaaaattagctgggcatggtagcacaagcctgtaatcccagctacttgggagactgaggcaggagaactgcttgaacccaggaggcggaggttgcaatgagctgagattatgccactgtactccagcctgggcaacagaaaaagactccttctcaaaaagagaaagaaaagaaaatgggtaaagaacgtgaataggcaatttgcagaagaaaaaattcaagtggtcaataaacataggaactaatgttcaattttattattaaataaatatgaattaatactagacaaaggaggaaatatcttttttaaactctaagaagaaacaaaatgataaacatctgagatatctagtctaaaaaaaggttggtacaacttcagagacactttatctgggttccttgctttttctctctgcttcttactccccataaacctacttctccccacaggaggtgccttctagacatcttgacatcgtggtgaagatggaaagagtgttttactagacatgccaagaaaggctctcccagttcaagtttgcttgtttggttgtttttttgttttgttttttgttcgtttgagagacagacctttttaccaaggtggctaacacaaagaattaacttgtccagctgagaactcacccctgagtcacagaggtttatgttactctggttaactcaaacatagaaccacaactaagcaaaccgcaacaactgcggcattcataaaacaagaatcatgcttaggcagtcatttaagtgggctcatcacaggacagtaaataatgacaaaagaaagcagggtgtggaagggaattgtgatgttaataactcgtacaatgcttaaatgcatgcccggcactgttctaaattaaatccttcaatgatcactacaactttgttaggtaatgacacatatccctcattttatgaatggggaaactaaggcacagcaaagctagataacttgtttgagatcacacaatcggtggcaatgctggaatttgaacccagagaatctggtgtaacagttcacactcaagccaccactttgagaggaatcaagggaaaaagaagagagatctaagagaataaaaaggggaggaaggaggaggaaaaactcagctcactaacacctgaaggcaattgctacatggtacccagcctcctttttcaggcccacacccaggtctttgcagtccccacctctacctctgttatcaagcttcctaaaatgacatgatttggggataagtgttcaaactatttttttcacaaataaatggtgtccagaggaattgatgttgtttcttttttctttttttttttttgaaatggagtctcgctctgtcacccagactggagtgcagtggcgtgatctccactcgctacaacctctgcctcccaggttcaagtgattctcctgcctcagcctcccaagtagctgggattacaggtgtgtgccaccacgcccagctaatttttgtatttttagtacagacagggctttgccatgttgaccaggctggtctcaaactcctgtcctcaagtgatccgcctgcctcggcctccaaagtgctgggattacaagcatgagccactgcgcctggcctgatattgcttctattgtatcttagattcagggggtacatgtgcttgtctgttacatgagtatattctgtactgggagtgggcttctagtatagccattacccaaatagtaaacattgtacctgataggtaattttctaactctctccccaatataataataataattattattattattatttttgagacggagtctcactctgttgcccaggctggagtgcaatggcataatctcggctcactgcaacctccgcctcctgggttcaagcgattctactgcctcagcctcccgagtagctgggattacaggcacccgccaccactcccggctaagttttgtatttttagtagagacagggtttcactatgttggctaggctggtcttgaactcctgacctcaagtgatctgcccgcctcagcctcccaaagtgttgggattacaggcatgagccaccgtgcccggccttattattttttatattacaaacaacaattgttttcagaaggaatccat[132 bp omitted]aaaccccatctatactaaaaatgcaaaaattagccaggcatggtggtgtgtgcctataatcccagctacttgggaggctgagggaggagaattgcttgaacccaggaggcggaggttgcagtgagccaagaccacgccactgcactccagcctggcagcagagcaagactccgtctcaaaaaaaaaagaaaaaaaaagctgcctttttggtttcagttttcttccctctgcctatgtgcaacctagagcaccaaaatcagaagatccattcatgccttttccgcagcactaagctataatttaaacaggaaaaggcaaagttgcagcttttgaacagccataagcccttacatcctagtaagatggcagactaaattgtagataactccagcttctcaaattcttaaaagccctgtagtcttcatccaccctgtgccatgtctttaggattctataagacagtaagactttatttctaaaccaactactgagattgaagataaaattagagctttaagccccttaccaaattaatgggaagagactctgaaaatttagaaattcacttctggagtagtggaagaatggcgaaattcacctactcagtttacagtggggcctctctccaagttcgagagcctgacacccagctgtttgctgagcttctctccttaggtgatccacaggcacctcacaatcaccatgctcctctttcctctcaacctgctcctcctcctctgttctccgtctcagttgaggacaccccttcctatccagtgacactggccagaaatttacaagtcacctagactagtggtcagtaagcttttcctataaaggactatttatagaaatatgtgaagctggcgacagagtgagactccgtctcagaaaaaaaaaaaaagaagaaatatgtgaagctttgcaagccatacactctctgctgcagctactcaactgctgctgcaggatgaaaacagctactgaacaatatgtaagaaatgggcagggctatattccagtcaaattgtgtgagtgctaaaatttggatgtcatgtcattttcatatgttacaagatattcttttgagttttttccaaccacttaaaaatgtaataaaccactcttagcttacaggttgtacaaaagtaggtgggctagatttggtatatgaagagcttgctgctctagaatcctcactctcctcccttccccacatctgatcagacaagtccaacaatctcactttgttttcttttttttttttttttatctgagaagggggccttactatgttgctcaggctggtctcaaactcctggtctcaagtgatcctcctgcctcagcctcctgaatagctgggactacaggtgtgcaccaccatgcctggagatctcactttttaaatggttattgaatctcttcatccatctttacatcattttagttcaggtacttgtccattttgctttttttttttaatttttgagacacagtctcgctctgtcacccaggctggagtgcagtggcacaacctcggctcactgcaacctctccacctcctgggttcaagcgattctcctgtctcagcctccagagtggttgggattgcaggcacgcaccaagcccagctaatttattatttttttttttttgtattttagtagagacgtggttttaccctgttggccagtctggtctcaaactcctgacctcaagtggtctgcccaccttggcctcccaaagtgctgggattacaggcatgagccaccgcgccaggcccattttgctttctgacatagacagttaagcaaaattgaaaactacaaggaaagatcctctacaactatcgtacatggaagtacatgtccttcccatgtttttttaagttccttatagtgtatagcataagttacagattagtttgccccttccttcagctggcactggataaataatatgttaatgcatgccaccattttctgctgtggcctgggaagagagggcatatgatgctctatcagctacctccagtgaaagggtctacaaagcagagagtgggagacagcatttgagagcatgctggctgtttctaacctcaggggctggctggactatgtctggccccttctttccagtggtctccacactggatattcagatctgctttcacttggaaccacacatctgcatgtggctaggacccagctaatctgccaaggacatttgaggtgtttgctcctcaatttctagttctctgccccatctatacctttgatgaggcattggacagcaatagcattcttgtctggaaacatgaccggcgggcaaatatcaagggagctagtgccacctacatgatgacagtcaccacatcatggtgacagcgagcaagagacattaggtaaaccactctttgatgtcattccttctgtgtaaaggggaaaaagaggaaatccaatctagttcctattttattcaattactggaatataagaaacatttcaggccgggcactgtggctcacacctgtaatcccagcactgtgggagtccaaggcaggtggatcacttgaggtcaggagttccagaccagcctggccaacctgatgaaactccgtctctactaaaatacataaaaattagctgggcgtggtggcgggtgcctgtaatcccagctactcgggaggctgagacaggagaattgcttgaacccaggaggcagaggttccagtgagctgagattacactactgcactccagcctgggtgacagagtgagattctgtctcaaaaaaaaaaaaaaggaacatttcaaatttgtgattgtttcctttttctatggtgtctaatcagtttcttttatttacttattgttctactttttaaatgtttttgtggggatgagagtcttgccatgttgcccagaactgttctcgaactcctgggctcaggtgatcctcccacctcggcctcccaaagtgctgggatttatgggcatgagccaccatgcccagccagtcaatgtcttaataaaacatcttctgcctgattttcgacaggatgattgttatctacttatctttcaatttaaaattactggccgggtgcagtggctcacacctgtaaccccagcactttcggaggccaaggcaggcggatcacttgaggtcaggagttcaagaccagccatggtgaaatcccatctctacaaaaatgcaaaaaaaattagctgggtgtggtggcacatacctgtagtcccagttactcgggaggctgaggtgggaggatcacctgagcataggaggtcgaggctgcagtgagccaagatcgcaccactgcactccagcctgggtgacagaggtagactccgtctcaaagaaataataataataaaataaaattacctttctcttcattacaaaagtgagctatgacagcaaaacttgctcaatgaataacacaaaaaccctttccacaacaaacacctagaaatgtaaaatataacaacatcacaaatagctatttaatatcatctcccctttcctcaaaccttgtttcctcttctgcatctcactgtcagcaaatgatcttctttctcattgcactgaaaaaaaaactggaatcagaagagagtatcctcctcccactgccaaatctaccaacctccctgctgcctttcctgatctcatccaatctcatggtcatatatataggcttatggctcccaaatttgagtttccaacccagatttctctaatctcaaaaatattatgcctggccaggtacagtaactctcgtctgtaatcccagtactttgggaggctgaggcgggtggatcacttgaggttaagagctcgagaccagcctggccacacggcgaaatcccgtctctactagaaacgcaaaaattaactgggcgtggtggctcacacctgtaattccagctacttgggaggctgaggcacgagaatcacttgaacccgtgaggcagaggttgcagtgagctgagactgcaccattgcactccagcctgggtgacagagtaatactctgtctcaaaaaaaaaaattatgcccagttgtattatgacctttcccattgcatatctcaaatttaacctggccagaacagtaccctcaatctaccccacaagcctgttcttttcccagaattccccatctcggtaaatggtgtcaccactcaattaattgctcagaccagaaacctaggagttgagtcagcctctctctttctctcataccttgtatctaatccttcactaaatatttgtgtctctcccttcaaaatatactttttatctcatgcctagctaaccacaatagccttctaacttatcttcctgtatccactctttactaccttagagtctattctcaactcaacagccaaagtgatccttttaaaacataatgcaggctgggcacagtggctcacacctgtaatcccagcaccttgagaggccaagctgggcagattgattgagcccagcagttccagaccagcctagacaacatggtgagactccatctctacacacacgtgcacacacacacacacacacaatatatatatatatatacacacacatacactatatatatacacactatatatagtgtatatatatacactatatatatactatatacatacactatatatatactatatacatacactatatatactatatacatacactatatatactatatatacactgtatatactatgtatacactatacactatatatactatatatacactatatatactatatatacacactatatatactatatacacactatatatactatatatacacactatatatacactatatatatacactatatatacactatatatatacactatatatactatatatacacactatatagtgtgtatatatatatacacactatatatgtgtgtatatatatatacacacatatatatgtgtgtgtatatatatatacacacacacactatatatatatatataaaattagccaggcatgttgatatgtgtgtagtcccagctacttgggaggctgaggtgggaggagtgcttgaggccaggaggcggaggttatagtaagctgagatcgcatcactgcactgcagcctggaccacagaactagaccctatctcaagttttaaaaaaccaacaacacataaggcaggttaagtcatgcctttgtccaaatcctccaatggcttctcttctcattccaagtaatcgcaaaagactatgaagccctggctaatctggcactttgctgcctctggagaagagctgctatccctctcccactccactccagtcactcaggcctccttattgacctttgtacacaccacgtccacttccacctcggaccatttgtagttgctgttatctccacttagaatgctcttgcccaaaatgataccatagctttcttcctcattttaggtctcgactcacgtgtcacctcatcacagaggccttccctgaaaaaaaaataaccactcaccccactcccgggacccccccatccccttaacctgctttatttttctccataccagttcacaccctctgacatcatagtattacattttctggattatggtctgtttcccccaaatagaatgtaagctcaataagggtaggactttcatcttgttcactgctgtatcttcagctcctaaaacagtttccagcacatagtagatgctcaataaatatttgttgaatgaatggataaatgaaaggcacaactgagtgcaagaaaaatagagtccagaaaggatgaaggaaatgaaaactagagggacatgcaggtgaactgtgatctagtgattcgagattcaacccctgtggccaagactattagttctgctctttcttttcctttctttctttttatttctcccttcctttcttcctatttttttttttttttttttttttgagatggagtctcactctgtcacccaggctggagtgcagtggcgcgatctcagctcactgcaagctccacctcctgggttcaggccattctcctgcctcagccttccgagtagctgggactataagcgtgtgccaccacgcccggctaattttttgtatttttagtagagatggggcttcaccg[136 bp omitted]tctctttctgctttccttttctttctttctctctctttctttttgagacagagtctcactctgtcacccagtggcgcgatctcagctcactgcaagctctgccttctgggttcaagcaattctcctgcctcagcctccggagtagctgggattacaggcatacgccaccatgcctggctcattttagtatttttagtagagacagggttttgccatgttggccaggctggtctcaaactcctggccgcaggtgatctgcctgacttgtcctcccaaagtgctgggattacaggtgtgagccactgcacccagcccaagactattagttattttctaacacccattctcctctacgtccacagaaatagaactactaatttttaactgcatacatggctacccagagtaatgaccactgtgactaacctctcaccaaggggatataaaagcaaatttcatgtggaggtactgggaatctcaaaagatagctgccatgtccctttcttcttggctctttagtttttcctattggctggaatgtgaaagtgaagcctagagctggaggaaccatcttggaccatgagatgacctgagaaatagaggtcatatagagtagagcaacaagatcaaaggaggctggagtgcctgagaacattacgaggacaaacagtccacactggctttggactgcctttctctagactgttccatgagagatcaattttcctcttgtttatgccactattattttgaagctctgtttctctcagctgaacctaatactaaccaatacgatgaacatacagagagaaaagccaaggccctggaaccaagaaccccatatacagactggatcttcacttaccctttccctcagtgaaatggtgaattagaaaaaaatcatatcagacttggggggtgcgggtggctcacaactttaattccagcactttgggaggccaaggtgggtggatcacctggggtcaggagtttgagaccagcctggccaacatggtgaaattccgtctctaccaaaaatacaaaaattagccggaagtggtggcacatgcctgtaatcccagctactcaggagcctgaggcaggagaatcacttgaaactaagaagtggaggttacagtgagctgagattgcacctctgcactccagtgtgggcgacagagattccgtctctaaaataaggctgggcctcgtggctcaggcctgtaatcccagcactttgggaagccaaggcaggtggatcacgaggtcaggagttcaagaccagcctggccaacatggtgaaaccccgtctctactaaaaataaaaaaaaaatagctgggcatggtggtgggcacctgtaatcccagctacttgggaggctgaggcagagaattgcttgaacccaggaggcggaggttgcagtgagtcgagatcgcgccactgcactccagcctgggtgacagagcgagactcagtctcaaaaaataaaataaaaggcagacaccattttttaacataatatctttttgtaggccggtatttaccttcaacagtattatttgcctagagaatgttttcaataaatatttgttagcggtgaaacgtatccatacagctctgcggcaacctcaattcttgcctcctcagaagaattcgactgacgggcgtaagggaaaaggagagagtgaggcaagttttagaggagtgaaagttcgttaaaaagctttacagcaggaatgaaaggaaggaaagtacactcagaagagggccaagtgggtgacttgagagacaagtgcccagtttgacctttgacttagagttttataggttggcatacttctagggtcttgtgctatttctcctcactcgcccaactcctgagatcttatcaggaagttgctcatcaccagtttcaggtgttttctattaggagactgcctttccctggcaccggctgtgaccaattattacttttttttttttttgagacagactgtccctctgtctcccaggctggagtgcagtggtgcaatctcgactcattgcaacctccacctcccagattcaagcgattctcctgcctcagcttcctgagtagctgggattataggtgcacaccatcacgcctggctaattctttttttgtatttttagtagaggcggggttccaccatgttggcaaggctggtctcaaactcctgacctcaagtaatccgtccatctcggcctcccaaagtgctgggatcgcaggtgtaagccatcatgcctggccacaattattactttagaaagacagttaaccactcattgcctgaccatcacgggatggttgcctgacactactggtgtgtgtgtcgggggagccctctcctgccctgctcataccttactagctacctactgtaacatacttactgaatgattgaagagaaacacaagaaagcccacctacctttccatacagaggcaaaaagtttaatttccttggtcaatcaggaaagatagtccccaagactcttttctattgtttcagttttcattaaccttttcgttgagatataattcagtgatttaaagtgaattcaacggtttttagtatattcattgagttacagagccatcaccacaattaattttagaacatttcaatgaaatttacgacattttcatcaaccccccaaaaacacttgtgcccatttgctaatgtgcccattggcagtcactcctcttccctgcctgccctccccccctcagtcttcccgccagttcctggcaactattaaattactttctgtctctatagacttgccccttctggacatcttatataaatagaatcacaatatatggtcttttgtgactggcttctttcacttagcatgatgttttcagggtgatatattcatacaatgaactattatctggcaagaaaaaggaatgcagccaatttataaggtattgcaagatttcagacatatttatacattttattttgtacatttttattgtggtaaaacacacatcacataaaatttaccattttaacaattttgaagtgtacaattccatgatattaagtacattcatatgttctgcaaccatcaccaccatctgtctccagcactttttcatcatcccaaattgaaaactctgtatgtggctgagtccagtggctcatgcctctctaatcccagcactttttgggaggctgatgcaggaggatcacttgagctcaggagtttgagaccggcctgggcaacatggtgatatcccatctctacaaaaaatacaaaaattagccaggtgtggcagcacccatctgtaggaggctgacgtgggaggatccattgagcccaggaggtcaaggcctagtgagctatggttgtgccactgcactccagcttgggcaacagagtgagacgctgtctccaaaaaaagaaaaagaaaactctgtatgcattaaaaaataactcatttcccctctcccagccccttgtaaccactattctactttctgtgtctatgtatctgactattctaggtaccttatttaagaggaataatatagtatttatccttttgcgactggcttatttcacttagcataatgtctgcaaagttcacgttgtagtatgtgtcagaatttctctccttaaggctgaataatactctattgtatgtggataccacattttgtttatccattcattcactgatggacatttgggttgttctcatcatgtggctatggtgaatagtgctgctatgaacatgggtgtacaattatctgttcaagtcccggctttcaattattttgggtatatatttagaagtgtagtcattggatcttatgacaattctgttttattttttgaggaacctccatactgttatccatagtagctgcactattttacattcccatcagcagtacacaaagatctaatatttctacatcctggatgactctttttatcttctgctttttgataatagccaaaccaacctaatgggtgtgatgtatctcattgtggttttggtttgcatttccctaatgataccttgttttttgtctgttttactttatttttaataaatcatattatcagttaaat[143 bp omitted]tactaaaaatacaaaaaattagccggacgtggtggcgggtgcctgtagtcccagctactcaggaggctgaggcaggagaatggcatgaacctggaaggcggagcttgcagtgagccgagattctgccactgcactccagcctgggcgacagagcaagactctgagactccatctcaaaaaaaaaaaaaagaaagaaactgtttacaaaataaataacccctatgtgtctaaaagttgtttaatttagtttgtttaaagtcaagtacatttgcaactgaagaaactaattgctgcagtcatttaagcattaatacggcaggcattgtgctggacagttgtcacaggtgaggttccccaggaagtaaactctgagacaggtggttaagtaaggagtgctctggggatgaatagctgtgggaaagagggaaagcaagcaggaatcaggtcttccacaatttttgaaagtttaaaggggtctctagatcaaaagtttcagagccactggtctacagcatactaggagaggtaaaacccccgcagagtcacttcaaatcaaatatttatctggctactaatagtggaagaccctctctcctgttcatctctctcccgctctcattccctactttctctctgtctctctcatctcctttccttttcccactctttcctaaaactatttcctatatgggtttcactctgcatccccgtgtgttggtctcccgtttatgttcatttcaccttctactcctcaaatcttttctgtggattgcaagatactgtgtccggaattggtgggttcttggtctcactgacttcaagaatgaagccgcggaccctcgcggtgagtgttacagctcttaaggtggcgcgtctggagtctgtcccttctgatgttcaaatgtgttccgagtttcttccttctggtgggttcgtggtctccctggctcaggagtgaagctgcagaccttcgcggtgagtgttacagctcttaaggcagcgtgtctggagttgttcgttcctcctggtgagcttgtggtcttgctggctccagaagagaagctgcaaatcttcgcggtgagtgttacggctcataaaagcagtgtggacccaaagagtgagcagtagcaagatttattgcaaagagtcaaagaacaaagcttccacagtgtggaaggggaccggagcgcgttgccactactggcttggacagcctgcttttattctcttatctggccccacccacatcctgctgattggtagagcccagtggcctgttttgacagggtgctgattggtgcatttacaatccctgagctagatacaaaggttctccaggtccccatcagattagttagatacagagtatccacacaaaggttctccaaggccccaccagagcagctagatacagagtgtcgattggtgcactcacaaaaaccttgagctaaacacagggtgctgattggtgtgtttacaaaaccttgagctagatacagagtgccgattggtgtatttacaatccctgagctagacataaaggttctccaaggccccaccagagcagctagatacagagtgtcgattggtgcactcacaaaccctgagctagacacagggtgctgattggtgtgtttacaatccctgagctaaacataaaggttctccaaggccccactggagcagctagatacatggtgtccattggtgcactcacaaaccctgagctagacacagggtgctgattggtgtgtttacaatccctgagctagatataaacactctccacgtccccaccagactcaggagcccagctggcttcacccagtggatcccgcactggggctgcaggtggagctgcctgccagtcccacgccatgcgctggccctcctcagcccttgggcagtcgatgggactgggcgccgtggagcagggggtggcattcgtcggggaggctcgggctgcacaggaacccacggaggcgggggaaggctcaggcatggcgggctgcaggtcccgaggcctgccccgtgggaaggcagctaaggcccagcgagaaatcgagcacagcgcccgtgggctggcactgctgggggacccagtacaccctccgcagccgctggcctgggtgctaagcccctcactgcccggggccggctggccggccggccggccgctcgtagtgcggggccctccaagcccacgcccacccggaactccagctggcccgcaagcgctgtgcgcagccctggttcctgctcacgcctctccctccacacctccccgcaagctgagggagcgggctctggccttggccagcccagaaaggggatcccacagtgcagcggcgggccgaagggctcctcaagtgccgccaaagtgggaacccaggcagaggaggcgctgagagcaagcgagggctctgaggactgccagcatgctgtcacctgtcaataccaaattgctcctgtttctatgctcgcagtatcattgtctttgataaagatagatacgatagattatatatagtttgttttttagaacttctgaataatatagaggcattttgttattgtagatgcaagcagtcagaaatatattgcatttcatctaccttgtaagttgacattgtagttttgtaataaagaaatttcaaaaattaccaacagtgtctatttaaaatttaccgtgaagaatgatagcacatgctgagttgtcatcaaaatattggactctcaagttgtcgtgagactcgattgaaatatggaagttcggcacctctgtttatttcaatccaagtgtggaaaccaccagaaaacagaaaagcacccaaaactccaccaagtgccaatgttcctccagtgacacaatgaatcttgaaagtacgtcatgctacaaaggacatgaaaaagcaaaatctaaagcaactagagaaaggaatctctacagcaatcaaataccaaattagaagaaggctttttgttgtcgttttgttttgtttgaagagtttttgcttttttggaaacaaaatgttttgctttctccatgcatcatgaaggaaacaaaaatacacagcttgttaaatttagttgcggctctgtcacaacaatgatgacaaaattttcctctgaccacaatgtgtttgagtacaaatggttcctctttccaggctctggcctgtgcatacacaaattcctagtgaggtgagacccactcccccacagcggggctccttctttttttttttttttgagacggagttttgctcttgttgtccagattggagtgcaatggtgcgatctcggctcactgcaacctccgcctcctgggttcaagcgattctcctgtctcagcctcccgaatagcttggattacaggcatgcgccaccacgcccggctaattttgtatttttaatagaggcaggg[136 bp omitted]agctatccttcatacatgaaggtgctaaggaattcaactgtatcctagttggtgaacgctatggcctttaaactcattcacaaaaaccggtgatcccagctgatctaattccaccatggccagccaggagtggtgcccagcgttggctatgtgtacctttgccagcttgtggagtggggatcagtagacaaggcactcctccctgatcctgtccctgctgtgccaccaagcccctttacattgactctcttccccaaaagggcttcatcattgcagcttgtgcatgtagcttgcctggggatgaaagggtaagaggaaacaggaaattgagtggcaataaaggagaaatgaaagaaaaaggactaagaacaaatgggacaatgtcagcagaaaggagaacaacagaagcggaacctcaagagacaagggaactgtaaagatgaaagagtactagaaattctaataatagttcccatttattagtgcttattatgtgctaggcactggataagcattttatgtcagtttcttcatctcatttaatcgttacaataaaccctgtggtaggcactattatagcattatgcctggtttacaaaagataaaacatgctcttgttatttaaaaaggccaaaaaaaaaaaatgcccacaacatttaacacaattctagaaagaagataaaaagaaacagaaaaatgggacaaatagaaagcacagaatcagatggtagatataagtataaatatattagaagtctggctgggtgtggtggcttatgcctgtaatctcagcactttggcagaccaaggtgggaggatcacttgagctcaggagttcaagaccagcctgggccacgtagggagacccccccatctctactaaattaagaaaaaagaaagaagtaaatctaagtgaactaaagtctacagttaaaagacaacaattgcctattggatagaaaaaaccgaatttgcactttatgctgttcccaagatcagacccaaaacataattgcactgaaaggaaaataaggatgtaagaaaatgtaccaggtacatactaaacaaaagaaagttaatgaagttataataaattagtcaaaatacacttttaagacaaagaatagtacttcattaatgaaaggtacttcatagtgataagtggtttggttcacgaggaaactataacaattctagatttgcgtgtatttgatgaaatagcgtcgaaaaagatatataaagcaataattaacagaattataagaagaatttgacaaatgcaccctcataatatcatagtgagaatcgttaacaccctcagtaattagcaggtccaaaggaacaaaaaaccagcaagtatgttgatttgaccaacacaatccacaaacttgacttaatggaacgtatagaacactgggcccagtaattggagaatatgcattttcctcaaacactcatggaacatttacaaaaacaaactatatgttgtgacataaagcaaacctcatcacactcgcaaagattggtaccatcctggaaactgggaataagaagttaaggaggggtccttgcttctgtggctgagaagtagcaaggctggtgcagcatagcaccagggatgccaatgaggtcacactgcagtcaacttgctctatgactgagggtcggaaaaggcagtccaggtcaacgactatgggaaagatgggtttatgcagggactgaactggggtgggttttgctgctcctccagaagcctggtattttccaatccacaaatgaggcctcaattctgtgcttgcacagggatctgtccaatagctagatatgcagagtgacctctggggatgctattgggatatgcaaatgacagcattaatggggtggagttacagatatgcaaagagccccctccttggagaggtgttgtggattggggcaagagggactagaggcttctttgtttaaatgaaaatactaattgccctacactttcaaagcaaacaatggagacctttcaaggcaagaaggtgcaggtgactaacacacaaatggagcatttgaatctttctttctttcttttttttttgagacaatcctgctctgtcgcccaggttggagtgtagtggcgtgatctcggctcactacaatcacctcctgggctcaagccatcctccagcctcagcctccagagtagctgggactacagcatatgttacagttcctgactaattattattattttttttggtattttttgtagacatggagtctggccatgttgcccaggctggtctggaactcctgtgctcaagtgatctgtctgccccagcctcccaaagtgtgaatgtttaaactgaggaaccctaaggccgaggagagatcctaacgccagggaactgagtggcaaagcactaacggggctggtaaagtgtacaaggattggacctgtcctgcctggaccagaacaggggacaggccctacatagagttttagatccagggtggggaaagtgcagtgaaaaggttgtaggggatcctggctaagatgccagggtagtggtagtggcagtgatgatagcaacgcagccagaagccaaaggaggggacctggatgctaagacacagaggcccttcctctttcagagactgaagtgttggaaaacagagcaaggccaattccagagaggaagggttggcagcctggaggaagtgaggccagggagcttctgaaaggaataatgaatgctttcaaggggagcaagagagcgtaggggctccaggccccaggaacatgctcctgtgtagagcagcaccccaagtcattttgcccagggaagaatcagcctcctggcacctgggctctgactgatggagccagcagtttgcctggaggctggccctgtccctggctgccaacacctcaaatattctttcctgggccttcttacctccagacaagaattaacaaactcttggtaattcatcttagaaagcaaaacaccacgtattatgtcagcatcttgtttgtaaaaagcctgctgtgacttcttattgcttatgaggtcaagccataaactgactgctctctctctctctctctctctctcctcctaacctccctctctcattctggtcatccttcaaggtctagttcaactcccatctactgtacgaaaccttcaaaagcacaggcctgtgtcacctttctttgaacccatatcacagatgagcatttgtaccatttttgtttgtttgctttttacattttctctaattgctctctatacctttccacaacttagaccaggagtttcctaagagcaggcctttggtttgttggttggtattcctcacagcacctagaaaaatgtacaatttatttattcaattaaaatatatttattgagcatgtattatgtgccacatatagttttgagtgctggggatccagctgggaaccgatcagaaaaaacttcttgccctgatggagcttacattctagtggagacagcaaatgacccaggaagcggaaggagagaaaggaagtggccatggggcttgcagttttcaatggggtggccaggacaggtctcagtgagagatctgacagaagccagggagtgaggcatgaggatatcttgacggggagagagcaaatagccaaagaaaaagtcaaggcaaaggccctcgggcaggagtgcacttagcttgtgtgaagaacagccaggtggtcagtgttgctggaggagagtaagggagccaaggagagcagtaggagagaaggttagagagataatggggtcagatagggtaaggccttggaagccatcttgaggactttagcattggagatttctgggtaaagggagt[137 bp omitted]atggcgaatccccatctctactaaaaatacacagattagctgggcatggtggcatgtgcctgtaatcccagctacttgggaggctgaggcaggagaatctcttgaacccaggaggtggaggttgcagcgagctgagattgcactgcagtccagtctgggcaacagagcgagactccatcttaaaaaaaaaaaaaaaaaaaaaaaaaaacctgctgtaaagtttggaggcccacaggtctacgggtttcaggacactgacccagtcacctagaagcgtgcctactctcaggcaaaacccaaagggtcctgtcagtggcctcttgtgcaagcaacactcccttgagtgaactccactaaaactgtagaagaaaaccacctgctgaagagcaaggacctttaattcaattaaacccaaacattgagaatgagttatgagccactaaccatgttccattcatctttatattctctgtggtgccagaggatgcctttctccaagctcccccgactcaatccactcagaatctaagtaagagtagagctcttgctgtacatacatggctccaagacaaggcccctggggattgttccttccaatcagattaccaccactaagctcctcctaggtagaaaacctggagtcaccctggacagtctgacctccaggagcttgaatccagtggcagaaatagacatgcacacaaacctctgtgtgatttgatatgatagaggaacgtgtctggtgctatgagcacacacacaggagggagcaaagaattttgcatttgggagttagagaagcccctaaaaaatgtgacacttgagaaatggaaaagcattttagataaagggaacagcaagataaaaggtttgcagtgagaaaatatcacaggtgacaaacaagaaccgggcaagtcataagtgaggaaacgctgactaggccagggagcaatagggagccctagggcatgtgcagacaggaagtacatgccctgttaacaaggtggcagcccatctgacatctgctgacggtttctacactgaaacaggtccaatattaccaggacttttgatttattaagagaagctggaaatctggggccttaggcaaaatctcctgacttaaaaaaaacactttggcatctagatccccatgaattccaacatgatatggaccaaacacaattgctcacaagggagattcagcctgaaggtggccagtcagccacctggaacctggaagcttggctggaagtgaagctaggaagagtgtggggaatctaacctgaagaggcaagcctgcaggcagaggagttgagactgccttttgtggcatttgatgaagggaggggtgtcacttaagcttaagctgaggagtgacatggacagattgctcattgggaagatctgtcttgtaaagggtagaccctcatggccagtttgaagactgtttctggaatggtaataaagtcctgaaatagaaccatagaggcgaaactgggtggtcgggggaggaatagatctgagagatgttttaccatctaatcagtgactgcaggactagacagtggatggggaactgggggtacgagatacaggaaagggagttgtcaagagtacatacttttagcattcatctctaattttggccaggcatgggggacagtgggtgggtggggaccaaatacaaaagacaacaaagagtattctagcttaggatctctctcacctttggcgctgttgtcatcttgagtagagtaagtctttgttgtgggggcggtcgtgtgcattgtattaacagcagcatccccagcctctactcactgcattccagaagcatgcccccgcttcagtcatgacaaccaaaaatatctctccatattgccgaatgtcccctgggatgtaaaattgcccctggttgggggccactgatccagaatcgggagggaaattccctgttttcaacttctcctttttctttgttttgcagtggtgtgaggttttgcttagaggactctttgtgagatttttgtctaagggaccagcacttttagctaagcccttggaatatgctggtgtctgtgtcccttttggactcaggaaggtgtctctaaatggatggaaggacacctgactttggaaagagggacatcattctttcctgccagacattttcttgcatatgcccttttcagcctccagttacagaaatggacgaagacttagtgagaagggcaaaggtcaaaacagttgagtggagtggcctaggtacacagggcagcgcagaactccagccaccccgggccaaagtgaaagaaaggccactggtagtctcgcacccaagtcatcaggactctaagggttaaacttgatgttgactcatcatgattttgatttacacaaagccaaactgaaagctccttgtctactgcagttcctggaaagccttctatctgtcttcattcttcctgcagaccagggcagtggcctgattcaatccaagacgctcttcgaatcacactacacggagattacaaatacaagttttatgttgaagaaacagcattcctgactctttccacccccttccaaaaatttgaaaaatcgttgcatgatgttcagggtcgggaagaaaggaaagtaacaatatagtcttaaggccagcaggccggaactatcttggtgaaaagaaatcaggtctctcccctctccacactgccgtttgttttttttcctcacgatgttcagattctcagggcttttctggaagctcatgacaagctgcaatccctatttttctaatcatttgctaccattactgttttattaagcgcttggtcaatctatgccaagcagtgcccatgatggcactcagccagtccccaggggctcctgttccaactaaagactccttaaaaggcagatgacataaccattttggaaacgttattataaacttattgtataatgtttatagcaaatgtcaacaagtgtatatgtccgtggtggtggaggaaaggccttgggatacacagtggctgacctatttgtgggagggatttagaaataatgatactatctctcagttctacaggccttgatactttacaaactgttttcataaacattattttgttcgataacacatgcaagccaggatttattttttttttttttgagaacggggtctcactctgttacagacccaggctggttttgaactcctgggctcaggtgatccttccacctcagcctccagaatagctgggattacaggtgcatgccaccatgcctggattctggaatttattctgaaccgttagccaaaagaatcaacatcctgagattcagcacaggcaggccctcctcctggaagcttcccttgctccttccctcccaaaaggtaccctttttgtatcccataattccttgttcttgcccttatcattgcccctcagactgactgcagctttctgttagcagagcttgcttttggtgagtgtcttcaacagttcctggaacaatttcataaatatttattgagtttgagagccttaattccaagagtggaacctttgttgtgaataggttaaacaaccctgtgccctttgggtggggtctagactaggtatattatcagcatttttattgctatactttttgtaactgttttcaggtatatgcattggcttaattcggccaaaatacacctcattatgggtctcatcatccacctagacatgattcttttttgggagaaggtgatagaataatgtccccctcccatgattccatatcgtgatccccaacacctgtgaatatgttaacttacatagcaaaaatgacttttcagttatgattaaatcaaggattttgagatggggagattattatgaattatctggtggacctaatctaatcacaagggtatttataagggaaaaggggaagtaagagggtcagagtcagatacgacaagggaagcagaggtctgagtagttccgcaacaagccaaggaatgtgggtagcctctagaagctggaaaagtcaaagacacagattctcccctagaatatccagaaggaatacatctctgcccacaccttgatttaagctcagtgtcacttctgacctccagaactgtaataaaataaaactgttaaatcactaaatttgtggtcatttttgacagcagcaacaggaaacgcctaaggactcttgttttccttcctcccagcctcactgaccctcataggcgcccaagtatcaatgtgtattcttccgattcacctcccatccctttgaaaaatatgtagaaagtttgtcgtgtgctttaaaaaatgcacgtatggtatcctccctcatgtttggaatgttccttttaaaatcaacattatgtattgccagctttcaaatatgccctttgtccttttcacaaagcacagtactgccagtgtccccaactccacccagtgaagtagggctggtattactaaccctggagtcagcgctagcaaacaagggctcagaggtcaagggctggaagccaggtctccagactcccaggccaaggctcttttccgcagatgactctgtcctggtgtccagcagggcacagcccctagcacctccgaggccccgcaagtgtgctggcagcggcgacgccggctccgccacgcggagggaggaggcccaggcagcgcccggagtgggcggcgacgtggtggaagaagttttgttcggtcagagaccggacgcgggagctgcgggtgggccaggtgtccagccttgggagccgtaggagccgccagagccgccagagccgccggcgccccgccccgcctcctccggccgctctcgccggctcaggttacctgaggccggtgggcggggcggcccttcccgtctgcgccggcccccagcctccagggcggcggagccgggaagtggaagagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccctcggggcccgaggggcggccggagggctgagggcggtgagggtcacggctgaaaggccccggaggtcaacgccgggcggagggccgaagctggggtgggtgctgggggctgccctcgcgaggccccgcgctcggcggctgcggcttcccgcgcgggatctctggggcccggtactggggccggttcgaggtgggacccgggagctgcggggttttcccgaactccgggtgcggcggaggtggcggcagcgaagtaagagggctgcgacttgtagtgggaagagcccaggaggctggcgtccaggcgtgcgggggcggggggcccgaaacatgcccacggcgtcagagggccgtgggtcagcgcccggaatgtcgcctgtgagcccgggaggaaatgaggcgccagagccggcggggaccacgaccgaagtccaggcgagctgagaacgcgccggggctctttgcccgaggccgcgccaatcctcactgtctaagggtggctcttgcgagtggaagttgaagggaacctctaaacatctcagtccttgttgaaaaaggacgtgacgctcatgacctcctctggcgtcgaagaaatcctttgggaaatccagaatagcatcccggcagatgctccccccaccccactctctttaataaaccttatattttagggtaattgtagatttatggaaaagttgcaaagatacttcagagagttgtgtatatccctcaccctgtttggtaacttctagttaatcaacctggcagttgtgaaaaattgggagttaatgacttccttaggagcagctcctggaaggaatggccttctggacgtttttggtgacaatgaaagccccaaactgtataggttttattatcacattgacacaaacacttatatatgcttattgcatttttaccaatgtgctttgaaatccaagttgaaatgttgattaggaaaccttaatgccctctatggattcagtcaataaaatacatgctgccaggcagtgtttaggggctgaggatgcagcagtgagcaaaacagatgaggtgcctgccctcagacatatcggggggtgggggtaaaatatatgatatgtctgagggtgttaagtagagaaaaacagagcaggtgggaaggggtttgccattgtaaaaagggtggatcgagaagaaaacaaatgttgctgaaaggtggcatttgagtagagacctgagggagacttgaagcttgtcagtcaataattattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttgtgctgcagttagttttctcatctgtgaaatgaggaggttgaactgcataaattctaagagctcctccagctctaatcctcagagtgtttataaaagtgattagattactagcttagtttaacctgtcccactcaatggcccacattgtggcatgtcttaattataactagcatgtatatagcatttatgcccagcagttttctagctgctttacttgtactatttcatttaatctttaccaataatataacttgtaggtgctgttattagtcccattttgtacacgaaaaagttgaggcacagtgcgaccaagacccttgcccaaattcgcatacctggcaaagtggaagagctaggtttccaaccctggcagcctgattccagaggccatgcccttaaccactgtactcattgcttctgcccagcagaaaagacgagagtccttagctggacacctcccagggtagcagggcaggacggcttgggacccacgaaagtatgtgcaagccatttgttaagaagctaatgatactatattaggccgggtgcagtggctcatgcctgtaatcccagcactttaggagactgaggcagatggatcacttgaggccaggagtttgagcctggccaacatggcaaaaccccgtctactaaaaatacaaaaattagccgagtgtgggattacatgcctgtaatcccagctactcaggaagctgaggcatgagactcatttgatcctgggaggcagaggttgcagtgagggaagatcaggccactgcacttcagcctgggcgacagagcaagactgtctcaaaacaaaaaaagaagcgaatgatactacattggagactggctttatagtggctgggctgtgtggtccaaacaactagtactataggcattcaaaagagaaaaagctgacggttggtagtgttatggaagaggtaaaacttgagctagatcttctggatgactgggatttgagtaggtggagaatttattccaggtgggggcaatagcaggagcagagacccagaaatgagggcaagagtgctcctttgtggtcaagaaggaacctggcttggcaggagagtgcattggtaaagtcaatccaggcagaatagcttgatttgcccttgaaagctctgagtccggcacagcatgggaaaaataacacagaaggaggaagcaagcagggagacttcactgggtaggggagcccctggagtgtgaagctacataagaatctatggttgcaggtctccactagaaaaatgtgctgcgaacccttcctgtccaggaccatgacttactggtatcttcccacctggtggggcacaacagagcatatttgcatgattggggtaactaagaaagatgttggaagaaaaaaacgaacaggagttgatgcctgagtggatgtaagggaagggacagatgactcatatatgactcttgtgatttccttaacttttcccaaaatgtgcatgcctctgctagctgctgtgattggacaggcgagagcaaaagctataagctaagcaaaatgccttcttatgaaatagtagattgtgttaactcttaatttaaataggatgttgtgctagatgactgtacagacttgggatttgaggtttagatacagacatacttgggtcccttcctactcccttttctgaagtcagtggtgcaatccccaagacatggttgaaattaggtgcctaagggaagcttatcaggtagaagggatacttgttctgtctcaaaggccagggacacata[131 bp omitted]cgaaacccagtctctactaaaaatacaaaaattagccaggcgtggcagtgcacacctgtaatcccaactactcggaaggctgaggcaggagaatcgcttgaacccaggaggcagagtttgcagtgagctaagatcacaccagcgcactccagcctgggtaacagagcgagactccgtctccaaaaaaaaaaaaaaaaagcaactctttagaattgttttgtcttaaagaaataaagcagatagctaacacatagcacttgctgcctgtgggcactattctaagcacattgcttgtattaactcatttaatcctcataataaccctttgcaagaggttactattattatcctcatattagagatgagaaaactgagaaatagagaggttaagtaatttgcctgctggcaagtagtagaggtgggatataaactcaggcagtcaggctccagagtctgtgctcttaaacactacactatgttgaagttatacacgaagagctgttagagacctttacaagtagtataatcatcacttaatcatatatatgtctaggcatgttgtatacacacacagttcacatgtatttgtatatatttaaacatttggagattaaagtttcagtgcctgtgtttttttcaattttttattataaaatacacataaaatttaccatcttaatcatttttaagtacacagttcagtgttacgaaatacattcataatgctgtgcaaccatcatcaccatccatccccataactctttttatcttgtaaaactgaaactctgtacccattaaacaataactcctcattttcccctgcccctagcccctggcaaacaccattccactttctatctctatgattttgactactctaagtatctcatatgaatgtaatgatatactatttgtcttttttgtgactggcttatttctgttagcatagtgcccttatggttcatggtgtatcatatgtcagaatttttccttttttaaatttatatatatatatatatttattataccttaagttctagggtacattgcacaacgtgcaggtttgttacatatgtatacatgtgccatgttggtgtgctgcacccattaactcgtcatttacattaggtatatctcctaatgctatccctcccccatccccccaccccacaacaggccccggtgtgtgatgttccccttcctctgtccaagtgttctcaatgttcaattcccacctatgagtgagaacatgcagtgtttggtttttttgtccttgcgatagtttgctgaaaatgatggtttccagtttcatccatgtccctacaaaggagatgaactcatccttttttatgactgcatagtattccatggtgtatatgtgccacattttcttaatccagtctatcattgttggacatttgggttggttccaagtctttgctattgtgagtagtgctgcaataaacatacgtgtgcatgtgtctttatagcagcatgatttatactatttgtcttttttgtgactgacttatttctgttagcataatgccctcatggttcatgttgtatcatatgtcagaatttttcctttttaaaagctgactaatattccattgtatgcatataccatattttgcttatctgtttatctgtcaatggacacttaggttgcttccatgttttagcaatttcacaatactattatgaacctgggtgtagaatatctctttgagaccttgttttcacttcttttgggtatatacccagaaatggaattattgtatcatatgataattctatttgtaatttttttgaggaaccaccatactgttgtccatagtgaaattttaaatttccaccaactgtgcaccggggtttgaatttttccatatcattgccaacatttattttctgttttttgatagtagccattctaatgggagtgaggtgaaatctcattgtggttttggtttgcattttcctaaatattagtgatgatgaacaccttcatgtgcttattggctatttccttatctttgttggtgaaatatctatttaagcctttgcctatttctgaattgaatttttttttattgttgagttttaggcattctctgtatattctggatattaatcccttatcagatatatgatttacacatatttttccattctgtgagtcacttttttctgtgaatattttgatgcacacgttttaattttttccatgaaatccaattcgtcaattttttcttttgttacctacattgttggtgtcatatccaagaaattgttgctgaatccaatggtatgaagcttttgtcttatgttttcttctaaaaattttatagttttagtcttaaaatttcagtctctgatccattttgaattttttttttacttggtattgggtaagcgtccaatttcattctttttcatatggatatccagttttcccagcaccatttgttgaaaagattgtctgcattgagtggtcttggcactgttgtcaaaatcatttgaccatacatgtgatggtttatttctggactgtctattctattacattgatcagtatgtctgtctttatgccagtacacactgttttgattattgcagctttgtagtaagttcagaaatcaggaagtgtgagtcctacagctttgtttttccgtttcaagactgtttggctattcagggttccttgagatttcataagaattttaggatggatttttctatttctgcaaaactatgccattaagattttgataaggattgaattgaatctatatatcactttggatagtattgacatcttaacaatattaagtgttctaatacgtgaacatgggatgtgtttccatatcatctacaaacagagataattttacatcttattttaactggatgtcttttatctctttttcttgcctaattgctctgggtagaacttcaagtactatgttgaataggagtggtgaaagtgggcatctttgtttcattcctgaccctaaaggaaaagctttcagtctttcaccattaagggtgatgtttactgtgggtttttcatatataacttttaagtcaattttcttacactcctagtttgttgagtgtttttatcatgaaaagtaaattttgtctaatgctttttctgtatcaattgagatgatcaggtagttttttcccctttattctgttaatgtggtatattacattgatcaagttttgtatgttaaaacatctttgtattccaggaataaatcccacttggtcatggtctataatccttttgatatgcccgtgtattcactttactgctattttgttgagaatttgtacatcaatgttcataaggcatatgggtctgtagttttcttttcttgtagcgtctttgtctggctttggtatcaggtaatgctggcctcgtagaatgagttacgaagtttgagaaggtttggtactagttctttagatgtttggtagaattttatctgtgaagctatcaggtctagggcttttctttgttgagagatttttgattactgattcaatctccttactacttataggtctgtttagatttcctatttctttgtgatttagttttggtggttttgtgtttctggaaatgtgtccatttcatctaggctgtccaatttgttagtgtacggttgttcatagtactctcttataaccctttttatttctctagaatcagtagtgattctagagaaatactcattttcatttttgaaaatgagtaaagttctcattttcatttttgattttagtaatttcagtcttctttcttattagtccatctagctaaaggtttgtccgttttgttgatcttttcaagaagcttttagtttcattgattttctctatttttctattccctttttcttttatctctggtctaatcttcattatttccttccttatgatagcttaagattagtttgttctttttctagttacgcaagttgtaaagttaaggttgctgatttgagatctttcttgtttcttaatatgtgtttatagctataaatttttccaatagtactgctttcgctgcatcgtctacattttagatgtttatatttacgcctttcatcaaatttgggaagttgtcatccattatttctttattttctttttttgagacagagtctcactctgtcacccaggctggagtgcagtagcacgatctcagctcactgcaacctctgcctcccaggttcaagcgatgctcctgcctcagccacccaagtagctgggattacagatgtgcaccaccacactcagctaatttttgtatttttagtagaactggggtattgccatgttggctaggcttgtttcgaactcctggacccaggcaatctgcctgccttggcctcccaaagtgctgggatgagccaccacacccggctcattattttttcaagtattctttcttcctctttctctctcttctcctggaacccccataatgcatacactggtctgctgatggtgtaccacaggtctcttagactctgttcacttttcttcaatctttttttctttctgttcctcggactcaataatttttattgccctaatttcaagtttattgattctttcttctgcctgctcaaatctacctttgattctttttagtgaatttttcatttcagttgtgctttttctgctccagagtttctttttggtctctttttaggttttctatctctttattggtattttcattttgcttacatatcattttcttgactctctccacatcttcctttagttctgtgaacatctgaagatatttgtttcagaatctttctttaatatatttgccatcaggtctttttcagggacaggtttgctgttgtttaactttttttctttgggccatagtttcctggtttttttgttttgttttgttttgtctgtcttgtgattctttgttagaaactggacatttaaatctggtttctctggaaaccagattcccccttcccccaggatttgctgttttttgttattgttttgtttattgtctttatttttttgattattgtaggctgtctgtgtgttgagcatcaacctgaagtgtaaacttagtcttctcaggtttttttctgggctttccctgagcatgtgtggtcactttctgtttttctctgtatatatagttttgtttcattttgttttgttttgtttttgagacctagtctcgctctgttgcccaggctagagtgcagtggtgtgatcacagctcactgtaacctcgaatccctgggctcaagtgatcctcccacttcagtctcctgaggagctggaactacagattcatgccaccacacctagctaatttaaccaaacaaacaaaaaaaattgttttggtggagatgggatctcgcagtgttgccagggctgatctttaactgctggcctcaagtaatcctcctgcctcggcctaccgaagtgctgggattataggtgtgagtcaccatgcccagcctctgtagttgtttaagaatttctaatctttaatgcctggctcccaaaagtggaaaaggagaaaaatgaggcgacaagggaagagcgccattcttttacatcttctggaaatcactttagctagatagggagggcttgcaacagtggggataggtgcaaccacaatggctgccagcctctttgtctgtacctctgtgatcagaagcagcaatcagtaatcagaatacaaatccctgatatttggaggacagagtacttctgcccacatagcccacaagctgtgggcagagggctccaggaacatgtgcacagccgcctgccatggggttggggatgaaggatgggcagctactactatgtaaaagctgacattgattgaaatttatggcaatttgttgttcaagcctttcctgggaaattgcaagccttcaatgtaagtgtttcctgatataactctgcagtcttccaaaattgttacatcaaacagactctgccactaccattgttatctaggtgaggagatagatgtctggtgcttcctactcttgccttattcccagaatccatgtgtgtgtgtttttaaagtgtaggaagtagaaaaatcaaaagatatggaggaaaccagaagagaaaaagaaaaggatagcagatagccccaggaagcccaaaatgcaaaccagttagaagatctgaccaaaggacacttcaaaacagatgggagaatattaatcccatttgaaaggttgaatatagggcaggccattgttttatttcaaaactgaggttaaagtaggttttaaattaccttgaaaataaattggagtacaattgaaatgaaccacaaataggtatatttttattatcagggctttaatatttgtgtgggagtgggaggtaggtgggtagggagagtactggaagtgctaaactaggtttcttggatgtgtttctgggaactgcagaataaggcagataatcctacagtaaattgtagtctccagtaggaacaatgtttttattggaggctctctacctgacaaatgatttgtcttcaaaaatatcattgatatggtgttagaaaggccaaaatggaatagccatacatgcttttaatcacttaaaatcctaactttagcactgttgcctgagccattggtgctccctggtactagctcagttttaatgcagtgcaataggaattctttgtttccacaaggccttgtcctgctgtgggctgctccttcccacagttggaccttgggaaaaggtagagttagaagagggaatgattttttttatttcaaattttattatagattaaagggtatatgcacagatttgctacatgggtaaactgcatgacgctgagacttggggtccaacaatctgatcacccaggctgtaaccatggtacccaacaggtggttcttcggcccccaaacccacctccctccctcccttgtctagtgatccccagtgtctatcatttccatctttatgatcatgtgtattcagtgtttaacacccacttatgagtgagaacatgcggtatttggttttctattcttgcattagatcacttaggataaaggcctccagctccacccatgttgctgcaaagggcatggtttcattctttttatggctgcgtagtattccatggtatatatgtgccacattatctttatccagtccactgttggtgggcacttaggttagttccgtgtccttgcttttgtgaatagtgctgcagtgaacatacaggtgcatgtgtctttatgatagaatgagttattttcctttgggtatatatcaagtaatggaattgttgggttgaatggtagttctattttaagtccttttttttttttttttttttttttgagacatagtcttgctctgttgcccaggctggggtgcagtggtgcaatcttggctcactgcaacctccacctcctgggttcaagtgattcttatgccacagcctcctgagtttctggtattacagttgtacaccaccatgcctggctaatttttgtatttttagtagagacggtgtttcgttatgttgtccaggctggtcccgaactcatgatctcaagtgatccaaccgcctcagcctcccaaagtgctgggattataggcgtgaaccactgtgcctggcctattttaagttctttgagaaatctctaaagtgctttccacggtggtggaaccagtttgcatttccaccaacagggtataagcattccctattttccacagcctcatcaacatctgttttctgacttttaaataatcaccagggaatgaatgttgagggtcaagggcctttgtagactgctgaccaagtagctgctatgtataaaattgactgttagagaaacctcaactacagagtgtctgtgagtttgatgttttgatgttttgggacaaatggaattttttgctcagttagggaggaaggtaacagtataaatattgctgattatgtaacaggcccagtgcactccaaagtattagcatagagtacaagatttaactctatcatttggtaaattactattactataatccttaagtaattaataatggttccgttcatcactttagaaaatttgggggaattattttcaaataattttaataaacttctatgttgaaataatttttgatttacagaaaagttgcaaaggtgggacagagggttcctgtatacccatcacccagtttctgggggatgattttgatagtctcaggagaacttctcaggaaagtttaaaatgatgtttcacagttcctcctctttctcttccctcttcagattagtcaaagctctagctccagctgtttagtgtcagacctcaggggaacaagggctgctaagtctctttctcagtacttctttggaaaagctataaaaaaacaattaccaggtcatgttagcaagcagaattaaagatgagcttcttaaacttacttatagaactgctgagattttgaacaatctgattttttgttgttgtcattgtttttgagacagggtcttgctccgtcacccaggctagagtgcagtggcatgatcttggctcactgcagcggcatgatcttggctcactgcagcctcaaactcccgggctcaagtcatccttttgcttcagccccccagtacctgggactataggcatgtaccagcatgtttggctaacttttgtaacttttttgtatagatgggattttgctatgttgccggggctggtctcaaactcctgggctcaagccgcttggtctcccaaagtgccaggattacaggtgtgagccgccgtgcccagtctgaagagtctgtatggagtgaggtgtggatcccaaggttagggaaccccaaattcctggaagagaacaacttggaaatattagtatttaagaatatcactcttctctatggaagtggttaagaatgtgaccttggagccacacttttcaagtgacactcccagctctgccgtttactgtagccatgggatatggaacaaattacttcacctgcttgttgcttcagttgcctcatctttaacatgaggccaataggccaggtgtggtggctttatacctgtaatcccagaactttgggaggccaaggtgggcggatcacttgagctcaggagttcgagaccagcctggccagtgtggcaaaaacccatctctactaaaattacaaaaattagccaggcgtggtggcatgtgcctgtagtcccagtaacaggctaggtgaatcacttcaccccaggaggcagaggctgcagtgagctgagatcgtgccactgcactccagcctgggttacaaagtgagattctatctcaaaaaacaacaacaacaaaaacatgaggctaatactagtccctatctccaagattgttgtgaggattaaatggattaatatgtgtggaatatttagaatagtccctggcccagtaaatgttagatgttgttaactcagttattactgtcttgtcctctaggacttgggagaattaagcaaaccattaaaaatactgttgataaattcatttttttttgtccttgatttgaacagaaactcagccacctgtgacaaatttgagtgtctctgttgaaaacctctgcacagtaatatggacatggaatccacccgagggagccagctcaaattgtagtctatggtattttagtcattttggcgacaaacaagataaggtaagttttctgcaacatgttacattgatgaggtaaagtgaacactatgaattggagccaagaataagccaaattctagtcttacgtcaaagtggaaattgtattttagggtgtgtttaaatttcagttggggaaattatagaagcaactattgacacaagtgaacacttaaaaatatttgctaattatttgacaattaaatgcaattgagattgctctgacaggaaatactagatatctttttctctaaggtactcaataaataattatgttattgttaaaatttgttcctatgttcctgcctgtagctgtattgccttgtatctatataacacttaattttggggaatttttacatttaccatcttgctaatcacatggacaaatagatgtacaggcactatgtggtgtaaaagtaaacggccatatggaaagtgaaaaagtaagttgtcagtggcaggtgtgtttgagtagagggttctgtaatgcccgcggaaaaaggaggaagactttcaagatttctagtcaactgatataagtgaatttttgttaataggtttggataatttcaggtcctttatgataatcttattcaacttttttttcaaaatctttttataccttctttcggtgtgtatgtgtttgttgcagggtggcggcggtgagtgggttgggtgtttggggttgaatttgtccaggattttgagtaggcagaatgagaagttattagcaacagtgctttgcatcagtgaattgtagaagcaccaagttcaggcagctttggtggcaggaagtcaggagaactagcttctgattggcactgtcactcttagctgactctatggcctggaataaattgcttaacctctctgagcgtttgtttccttatgtataaagtatggctttactcacttcgctggcttgctgggacacagaaaataatgtatatatacaaaagtttaatagtcaggatggaacatgctcttcctctggagggaaatttgctaatctgccttcctctcccttgtcctgctgaggtgttacttatggtttaggcgttaattgataaagaattgaggcttatcagaagtatttgcattttaaaagaggtcttctaaatgtggaagccaatgatactactagcagtgagactggagtttgcctttacatactgtcggcttcctcttgttcctcctaaggaagggccttaggcatttggagtcttagtggtgatttttggtaattgagccttgagaaattcacagaaagaccctaagtgcctctggctgtaagccctgtaatcacccaagtgtctaactgaaaccctgagcagaggttgcttttcaggtcccttttccttaagttgtcaaggatcaatcaggtagccaggctggtgttctagcctagaaatggggctatttcctcagagtatgtgcagaaatctagagttaaatgtaactttaggagacagtagaatcagatagaattgtgcttgaaattttatctcttcccgtttcaagctgtttgattttgggcaaatcacttaacctctctgagctcccattttcttgtttataaaatatggggttgttttggcggggggcgggtaataatagtaccaactgaatatggatggtgtgtgcattaaaggagatgaggtttgtaatgcacctgacacagagttagtgctaggtaattgttagcttttattattgttactgttgttaggttgagccatgtgaaattaccacttttatgggtcaaaatggttgaatgttgtcagtattatttgtcagcctaatattatcatttaatcttgtttcctccattttacccctgaagaaaccagatagagaccaaaaagggtgacctctgcctaaggccagctcattcattgtagccatttgacagcattgatggccatcagtcctacatttgtgatgaacacggattattccttccagtcagtgataggagatatcctgtctggacctttttcaagtttatcatcaggaggctgaaaatgaatggcagaagtaattttcctctcctctttctgtcctttgggtacagcattagcatcattgggccaaactgaggtatccctgaagcatattgaagcaatggcattatgatagtttgtacattagggggcttaggaaaatgttcaaaggtcccaagttgctaaatgagataaacccttgaggtcattttcaatcttaagattggaggctcatcaagttgagagacagggatttgcagaggatttttggaaaagaaaagattagtgtaaatggcagccctccaccattttttaggcagtgtctaatagttcctcagctggcaagtagaaggaggatctagcatcagattttagatatctttcatcactaagagatgggcaagtcccattaggcaaactaatcaaaaggccaggcatccaaataggaagatgctgaagctaactccctttctttttgagaaaggaattctggagttgagaaaggtgcagtccagccaagtgaacattggtctggggagatcagttcaggactcttgccttggtttttgataaattttcaaagggaatcagattccctgcagggtggagcataacatcatacagcagctaccagtgggaatgattcaccaaagccaaaagtcacatgggagccat[136 bp omitted]accctgtctctactaaaaatacaaaagttagccaggcgtggtggtgtgcacctgtaatcccaactacttgggaggctgaggcaggagaatcgcttgaacccaggaggcagtggttgcagtgagccgagatcatgccactgcactccagcctgggcaacagagcaagactgtttaaaaaaaaaatctgatggaaggaatttaggaatttagtttcttgtgtgatacagagaggtgtacttgacttggcagttgttgataatctgggttcctactttattagtgccagtttaatattgtttaccttgaactttgaaagaaattaaaaaaaaattatttgaaaaaattttccctctactgtcccttttctatgttattattcatatgcctgaagcataaggttcggatttagatactaaggcattttttaattttttatgttattttattttgaaatggagtctgctctgtcacccaggctggagtgtagtggtacgatctcagctcactgaaacctctgcctcctaagttcaagcaattcttgtgccttagcctgccaaatagctggaactacaggtgcatgccaccacgaccagctaattttttttgtatttttagtggagacagtgttttgccatgttggccaggctggtttccaactcctgaccttaggtgatcctgacctcaggtgaccttggcctcccaaagtgctgggattacaggtgtgacccaccacgcctggccactaaggcattttttaaattaaaaattccattgtgataatttttgtgtactaaaactccgtaaccctctaactggaacaatgtccattataatatgaaaactgggattatcttcatgatgattctaatttgactgtatttgactgtacagtctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaatttcccggagagcccattaatcttattattctcagtcatagtaaccagactggtgatttatgtctctatgatgtctataaattggcttcctatggttccacaaagcttatctacttttcagaatgagagtgtatatactcagcacatatagcaatgtttgaaatttatacatatatatgaggtagtcaaaatagtcaaacagtagagaaagaggtttaatgaaaagtctctcttcagccctcaggccctcctcctttacttccttacccagaagtaaccatgattactggattttttttttgagacagggtctcactgcattgtccaggctagagtgcaatcttggctcactgcagcctcccgctcccaggctcaagtgatcctcccacctcagcctcatgagtagctgggactataggcatgagccaccatacctggccaatttttttttgtacagatggggttttgccattttgcccaggctggtctcgaactcctgggcttaagtgatctgcctgcctcagcctcccaaagtgctgggattataggcatgagccactgagcctggcatgattcctggattcttaaagcatccctttttaaccttaattttcctggtacagtgcatctacttctaagtgaattttgataatcatattgtttcctttaaaattgcttttagagagttgatatgttagcattgtaggtttataggtaaatttcatgtttatacctttaaaatgtgggaaattgttgtatctacaccagggtttctcaatggtgacactagtgacatttgctgaagggtttgttgtaggaggaggggggctgttgtgtgcattgtaggatgtttagcagcgtccttgacctctacttactagatgctggtaacctccccctcccaagttaggacaataaaaagtgttcgatattaccaaatgtctctgagagcggtagggagaacaaaatcagccccaattgagaatcactgatctataccatttgataacttttttgataaaaaaagcaccacatttagacatgctaatgtttcattatataagtgtgtgttagctgaagcaatgcctttttcaattttctaaccttagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtaacaactgaaagcgctatctcttggtgtttagagaataaatctgaatgctccaatgcttttgtgcattgttcattaattaattcaattctcaaacattttctgagtctaataagtgccaggcattgtactaggtgctagcagctcaatgaaaatatgagtatgtctctgccttgaagaagcttacaaacaacttgaataacaatgcctaatagttatataaaatttaataatttaaaaaatgatatacacatgcacgcgcgcgcacacacacactcacacacacacacacgcacacccctcctttagatcgagagtcacaagcttatcttgtgaagtgagtaaggcatgtattattaccctgatccattttatgaggaagaaaggaactgcgtgacttgctgtatgtcttcacatttcaggcccagtgctttaaaaataaaacacaaaatactctcttacccattatgtgtgatacttagtttgatatgcaggatatatttgggaaaagatgttgtttaaagagaaaaatattatgctggcctggctccaatacaagtctagacaagatagtacaagacaaccttaggaaaagctgtcaagtagtgaggatgatcattgttccccaatcccacctctcccaatgtccttctggctcttatgttacatacagggagtagcatatactgattaagagcagggctaccagaaaccaactgtctaactttaaatcccagctctgccagctactagctgtgtaaccttgggcaaatttcttagcccctctgcaccttagtttcctcatctgtaaactgggcatgatgatagtatctatctcctagaattattgggatgattacgtaagtcagtatatgtgaggtacttagaatagtgcctggcaaagagtgaatgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcaggactgccaggagatttgaaacaacttacctgccctattctcctttccttaggagttaacgaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatcacatgactgcactccagtctgggtgacagagcaagactctgtctcaaaaaaataataattactatactatgacataaaatggttgatgatggctcagtgtagtaccccttcaaggatcatgagggataacagatttacattttaaacagaggtgtttaatttaaagacattataccttaactaaaatggctttataaagatagagattttaggtcagaaagatactagggctcttaaagtcatgacacttaagaggcaactactaagagttaaattaggcttacctttccccagaattgcttcaggaggaatgtttgtttgtttgtttatttagagacagagtcttgttctgttgtccaggctggagtgcagtggcaagatcttggctcactgcaacctccacccccctggtttaagcaattcttgtgcctcagcctcccgagtagctgggactaaagatatgtgccaccacacctggctattttttgtatttttagtagagacagggttttgccgagttggccaggctgttcttgaactcctgacctcaaatgatccacccttgttggccttccaaagtgctgggaatacaggcgtgagccaccctgcctggctgaatgtttattttttaaaaaatgtgtcagtattgatcaaaagacagaaagttaaattgtacctcaataattttttaagacagatatatataagggttgtttgtatatccacattcatttaggaattgtgtagatattgtctatgattgaaatagtttttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgtttaattttttctgcaaactcaacaagatggacagtttgcttcaatgaaaaatgcatctgtctttggtgtctactttttaaataaactttctatttttaaatatagatcctgtatattaccagaaaaaatgtacagagagatcccatatactccactcagtttctcccagtggtaacatcttgtgtaactatagtgcattatcaaaaccagaaaattggcattggtacaatccaaaaacctcagtcctatttcaacagttttacatgcactcgtgtgtgtgtatatgtagttgtatgcaattttatcacatgtgaagatatacaatggttgcatcaccataaggagttgctcttttatagccacactcacctccgtcttaaaccatctctccttgtacacccctctcccccaatcctctaacctctggcaaccactaatctgttctccagctctttaattttattatttcaagaatgttactgaaatggaatcctatagtatataaccacttaagactggcttaaaaaaaaaaaactcagcgtaataccctggagatctatacaagtagttgtatatcacgaggccactcctttttatagctcagtagtattccatgatatggatgtaccagttttttaaaccattcattcattaaaggatatctcagttttttccagttttttgctattatgaataaagctactgtaaatattcacatacagatttttatatgaacataacttttcatttctctggaataaatgcccaagagtgcaattgctgggtcatatagtaatggcttatttagtttttttttttaatgccaaactgttttctaaagaagttagttcaccttacatttccactagcaatgcatgagttattgatgtctacttttaaaaaggaaaatgatatgtccggggtcaaaaagttgtttgtttgtttatttatgtttttgagatagagtcttgctctgtcacccaggctagagtgcagtggtgagatctaggctcactgcaacctctgcctcctgggttcaagtgattctcctgcctcagcttcccaagcagctggaattacatgcatgcaccaccatgcctggctaatttttgtatttttggtagaaacagggtttcaacgtgttggccaggctggtctcgaactcctggcctcaagtgatctgcccatctcggcctcccaaagtgctgggattacaggtgtgagccaccacacccagcctcaaaaagtagtttagcttcctgcaaaacaactttgatattttgatatttgatactttagtatttggtatttgtgactatatctactacaaagtttgttaaatttctaagttagtcttccatcattccctttagagcctagaattattagcaacagaacaaggaagaaagaccagattaatccagtttaattcagtaaacctttatttagaacactttgtggataaaccactgaatgcacagcagagacaaaaaacatatctcttctctcctaaagctcaaaatatagaggagaagatagtgcctgatacagtgacctgcattaaattaagtaagacagtgtatgctgaaggctgttgcagagggatagatagattcctgtgggaagttaggttggagcttggggtggtggtcgaggggaggtggatgggtggatggagaggggactgagaggctttgatgaaggaggaagactgcctagatgggggagtttctctgatgctggcctctggggaagagcattttgagaaatggaggtatttaatcgttgtgatgtcagggtggagaaggggagacctagcataggcagtctgcctctacatggccttgttccctgactgtcatttgttaagacttcttctgagagaatgggatgtggagagccatgtccaagacttgtgaagctactggataaacatggcctttcatgctagagtgtctattttgcctgatgacatgatggaaagcatttttgatacattaaaacactcatggctatatcatggaatagaatgcaaaaaaaaaaaaaaaaaaagtaacacacatttttggatgaaaacctccaaagttgccccaggattcacatccgcactcctccctggtggaaggatcctcctggcaaagttgggaaatcctgcaggtggagccagaagttctgtgtggttatgtctgaggtctgtttctttttccccccctgatgtaaatctcatttgaggttttgtagtttcacctgctcactcttggtacctgttgtttctcctttacttaaaacccttcagtggctccctggtggctttaggttaaagtccaaactctccagcatgacagacaaatcgctttatgacagacctggcccctgtcaacctctccagactcggttgcatctgcctccatgcacccccgcccctcttgcagcctaccattcgcccgcagcaaacttctttcagttcctcagactgctttcttcaaatactcaaacacaacactagatttcaaacagaatattcaaacagaatagtggaaacattctgcatcctcttgtagcctaggcctttccttttcatttggatgcctcttatttgtctttatccttatttcagcccagacaccatttcctctccagaaagccttccttgacctctcaagtctagacatgtgtcccttcctcttgtctcacggcaccttgcaatttcttgtgtcatactacccagcacattgtgttgtcatttcctgttacttggtggtagcctgctacaggcttcagtttctcttgagagcgggagctgtgtcttgtttctcctggtgcctgatatatagtaggtattccataaataagttgtgaatgtttggtaggatccaaagctagagaatattcagggttgcggtgatgacttatgaggtataagcaactgaggaatattatggttcatgaataaaaagagagaaggattgagtagatccagctccctaaagaattgctaagaaggggccaaagaactaagccttactaagaaggagtagcctggctgttgatgttgtagtaaagtttagggagagctgttacacaggcttttaagatgtcttgtgagttggcagcatccatgtgtttattatgctattaacccctcttgttttccctggaatcattattggtaaaaccgcagggaaaacctttaaagaatctatgtctatataagggactggaaaagaagggaagaagtcttaaaactgtatctcattccatggcagactgggtagaaaattatcccagctattagaatcagggtggcactggaggcagatggtagcctagtccttggggttcttctaagacaaaaatagggaagtgccttggggatatactagcaaaaacaaagtctcaatgcaaattgttaaaagaatgtttcctctgggtgaatgaattacaaaaaaacctggactgaccaatttgaaaaagcattcctcttcctctgggctgaagcaggctctcaccaaagctgagagcagatggtacttgggctggctttcagccctcagttgatgtctttttgcagggaacaatctgcacagccactggaggtcgctcaagatgcaattccaagatagtggtgggtcactagcatccaagggggcagatatcaaggatcctacttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatatacagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggagccacactgcttgggttgaaatcctggctctcttccttactttagtgtgattttgggtaagtcccttctctctcagccttagtttcataatctgtgaaatggagatagtaataatagtgcctacttcttaaggttgttgtgagggctagtgtttagagccatgactagctgctagcatatg[256 bp omitted]gcttgcagtgagccgagatcccaccactgcactccagtctgggcaacagagcaagactccatctcaaaaaaaaaatactatttattattattattattgttattatccccactcctttgcagatgcagtcagtacacagcgctggcctcttcccgtctcacagaattagtacctaacccatatctccttctttcttgctctcctctagatagatcctttctaatcaaaaccacaaaagaaagggagtcaagacacagtgctcattagcaagcaccagaaatggtttaggtaccagtataaatcacatcaaacaaactgccagagactgttttccctaacccccaaccataaaatacggagtctttcttttttttttttttcttttttttttttttggagacagagtctcattctgtcgccaggctggagtgcagtggtgcgatctcggctcactgcagcctctgcctcccgagttccagtgattctccagcctcaacctcctgagtagctgggattacaggcacgtgccaccacacctggctaatttttgtattttcagtagagacagggttttaccatgttggccaggccggtctggaactcctgacctcaagtgattcacccacctcagcctcctaaagtgctgggattacaggcgtgacccatggcgcctggcctggagtcattttttgaaatcaaaataattcattgaagccctagggcaatgacttgtgtccctgtagggacagtctggcattgaacagaccccggcctgaagagcttcagactagtcatgccagcgaattttagggattttttttttttttaccacattaatcatcttctgagttgggagaatagtctttaatttgtcaatttccttctcatatctgcagtgtgactctgcagatgaattcagtatataaattttaacaggaatcacctgctgttttaggttaatgtttcacaagaattcaagaaatgttatctattcagaaccagtattttcccttctataattatttctaaattacaacaaaattgttttaaaatttcattatctgagatccatgagcatatgcagaatactcagggtacagaaatgaaaaagggatcaagaagattgtgcattcgaggagttcctttcatcattaaaaacaattttacacatggctttctttagttatgtaagaaaaatgtcattaaatttcttcagtttctgtttttggccatgggcggaaaacattccaggacagtctgatccaaaaactagtcatgacaataacttcatttttacaacactgttttcttcataaaccacagggcgctgcaactagggggaaaagcttatgtactacctattgaaggaaaaaagcattttctatatcgaagcattcctttgtgcagcctttgaaggaataaatacattagctctgagtttttttttttttaaactgacttgcagcagaatctcctggagaattgctgttcaaatgctggttcctaggtcctggcaaaaccttctaaatcagattttctgggagagggtttgagaaacctgcattttaaagtagtacagaggattctgaggtaacaggttaaggatttgggactctttactcttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattgtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaacagtttggtggagaagagggtgcatgatgtgttttggacactggatttgaggcaatggtagaacactcaaatggagcagttggagatctgggatttgttctgaggtgagatgtcaggattaggaattaccagcatagaaactgtagttgaaggatgagggagtgataaactggatgtgagtggatgagggagtcagaaagagggaagaatgtgagtagtcctcctactccccctctgctggaagagagaggagggaacagaacaagccaagaaacaaggaaggagcagggcagagggaccagaggaggaatcgtagacttcagcagataggcattttcaagaagcatgaaacttctaatcccagccttagaatgtcttctcttatacagaagaaataggcctcctgtagtctctatagctgctgacagtaccagtgttcatcaaaaaggaacaatctaggctgggtgcaggggctcacgcctgtaatcccagcagtttgggaggccgaggcgggtggatcacttgtggtcaggagttcgagaccagcctggccaacatgctgaacccgtctccactaaaaatacaaaaattagccgggcgtagtagtgtgtgcctgtaatcccagctactcaggaggcatgagattcactggaactcgggaggcggaggc[133 bp omitted]atagggtttttttaaaaaaagttatcttgcccattgcaaatattgcttttcatggacatctcagtcattaaaaagaattctgccttttttttttttttttttttttttttttttgtggaagggtcttactcggtcacccaggctggagtgcagtggtgcaatctcagttcactgcaacctctgcctcccaggttcaagagattctccttcctcagcctcctgagtaggtgggattacaagcacctgccaccacacccggctaatttttgtatttttggtagagacagggtttcaccatgttggcaaggctggtttccaactcctgacctcaagtgatccgcctgcctcagcctccaaaagtgctgggattacaggtgtgagccaccgcgcccagcctgctcttatttcttgaatactctgttgaatataatgcagaagattgtctcattttatcttgtaggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtggtaagttttagaagtcctctaaaacagtatggataaaaagtgtgttatatcttttgcacaatcaatacaaataataaaaaatgatcattctgggtttaagatcttctgaaagaagggactatattgatgtataactttctttgatagatcctttttaaagaagtaaacttggaaattctttttattgaacacatgtgccagatgctttatccttgtttagagtacactgagagttagaacagttagttgtagaaccaacattggaattgtcttagttcattttttgtttggtattttctggtattctgttgcttataacagaataccagagactgggtaatttataaagaaaaggaatttatttcttagagttctggaggcagggaagtggaaggtcaaggggccaagtctgatgagtgccttcttgtttgtggggactttctgcaaagtcccaagacagcacagggcatcacatggttagggagttgagcatgctagctcaggtctctcttcctctttgtatacatccacgagtcccactcccatgataatccattaatcggtcaatagatcaatcaattcatgaaggcagaaccctcatgacccaattatctctttaaaggtccaacctctccatactgccacattggggatgaagtttcaacatgagtttgggagaagataaacattcaaatcatagcaggaacccaggccatctgactctaaggtctagtctcttgatacttaaagaggatgatactcataatgatcatatgtagttcctaaataatctgtctcttagaaaaggcatagacttaaggtagtgtaatcgggtgatattcaaaatatttaacattctgtatggcatgggcactgatcagttagaaaaaccagtatagccttaactgtgggtgccagctgcatgtcagcctgttagaaagcaccctcagcttgaacacagattatctgattaggttctaactccttcactttgggcaaggcatataaacccccttcaaatatttccttatctgtgaaatggaatatataatctccctctatctaaaaaaattgtcataaggtccaaatgacataaagcgtattaacacattgtgtaaattactaaagcaaattccattagcgtaatggtttatttgttgaaatatcccaactgggagctcagattctggcttagatagtcatagaagtgaattctaatagggtaccaaagtcagcttactttgtaggccaagggagtgaggttggagtattttgcctagtggggtaagctgaagcagagcccttctctttgtttggcagattatcttagatgatcttttaagtcttattttgctgttttcctctctggatattaatggtgacataaaggaagaaggaagatccttctcagatagaagatgatatcttcaagttgttttctgttaattacccattatcttctattgcttggtcttaagtatagctgactcctgaaaaagtaaattgaccaggctaatgcatttttaaaaataaattatttttttctttttctgagacagggtctctgttgcccaggctggaatgcagtggcgtgatcacagctcactgcagccttgacctcccgggctcaagctatcctcccatctcagcctccctagtacctgggaccacaggcatgtgccaccacgccaggctaatttttgtattttttgtagagacggggttttgccatgtttcgcaggctggtctcaatctcctgagctcaagcgatctacccaccttggctcccaaagtattttactcttaattgtggttataaacacacaacattaaaattaccatcataaacattttaagtgtacagttcggtagtgttaagtatattcacattgttatgcagcagctctttagaactttttcatcttgcaaaaccgaactctgttcattaaacattaatttcccctcccctccgcccttagcaaccacctttctactttctgtttctatgaatttgactacttaagatacctcataggagtggattcatacaatatttgtcttttgtgactggcttattttacctagcataatttccttgaagtgcatttatgttgcagtgtgtgtcagagactaagccaatgttttaatggtggtctttgattggcattaataagtgacaactagggaagccccttgtatctggtgccttattactcatcaggtggaagtacatctggatccaagcctttctttattctctatgttgcgtctagatgtcctgattataccctggccattttctaaccagatgcaggtcagagttcatatcatctgctagataccccaaatatgttccttaaattcattttactaggcagttttaaataaacttcttctataattgtggctaaatagaaattctaaaactatgtatctgatcatgaaaggccactaaatgcatcagctctgttttgatttaactttatgaaccctgcatatatctgcagttgtctctcagtatttgtgagggattgcttccaggaacttccaaggataccaaaatccatggatgctcaagtccctgataaaaagtagcatagtacttgcatataacctatgcatattttctcacatactttaaatcatgtctacattacttataatacctaatacaatgtaaatgctatgtaaatagttgttatattatctagggaataaatgagaagaaaaaactctgtacatgttcagcacagatgctattttttaaaaaatattttcagttcatggttggttgaattcatgaatgtggaatccatggatatggagggccgactgtgtgtttgtgtgtataatcaagctttggaagcttacttgtgttctatttttgtttttcagtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtaaggttttaaaattattgtttttatttggctatttttcttttacttgaatttcttacattgaaatatcaatgaaacatagctcttacatttgtcaccttatgatgatgatggtaatgaaacttcttgtctaaaataaggcatggtggaagatttgaagatttatggtatgatagtatcagctgcaagtttcaagccatttattcatctgtaagcttcttagaaaggcctattaaacgataattcatttgctcaacacgttcttattaaatatccaccacatgccaagcactcttttgtgtgctagggataaggcagtgaacatgacacctgacaagtttttttcttcatgaaacctacataatagaaaacgtaagtaaataagcaagctaatttcagaggatgagtgctgtgaagaaaataaaatgggctgatgtagtagagtgactgggagaacgagagggaatattaggtagggaaatcatctgaggtaataacatttgagatgagaccagaatgatgagcagacgctagccatgtgaagatctgggtgtagggggtcagcagatacagactctgaggcaaaaatgagcttagcatgtgtgagagaacagaaaggagggtggtgtgaacaaaatgtagcaggaaaagatgtctaagcagtaggcagacatcagatcttgcggacactttggaggctctgataataccattctgttttcttggagtttgtggcaactaaagtaatcagatttgagtagtcaatatttgttggattatgtgcctgtatgctattcagaatcaaatgcagaacatgctaattagaggccctgtaggacactgaccagagtgtactataatctcaggacatcagtccagttgttctgctttagggtaaaggtcacaaactagggcctcacacttttttgtgtggaacacaaagtcgtgttttgtttgtttgtttgtttactagatttgaattttttgcccagattttaaatcatagtactttaagagtgtgtgtccataagatggcgccttaagaccatgaagactgcaccactcacttgtctgctacctgcctggaccctttgtgtgtttgagttttagagattagaagtgaagtgttttatattggcttttaaaggagcctagcatctcgcacgtgggtaaattccttggtccagttgttttagctcatcatggaacttccaaaatgcttgctaaaataagccagtgttgacaggctataattccaactccagagggagtgaccaagtccacagcagaacagaacagcaaatgctcttctgggcatttgcattatgaatccttctgctgaaatataataatcattactagtaccagaaattaagtgccccatgaaatgcagcaaagggaaaaatctaagggctttcatgtggaagggggctggtacttgaatttacaacaaaaggagttatcagaaagctgaaatacacttgtttactccagtctttactgttctctcctgtctgaaatcctgagatgcatgtctgaaatcctgagatagtattcattttgccactcaattattttctgctgtttaacctatcacatgtatgcattttctctccactgaaaatatagactcctacagaaaaccaaatgccacatgttctcacttataagtgggagctggacaatgagaacacatggacacatggaggtgaacaacacatactggggcctgtgggggctgtggtgggaggagggagagcatcaggaagaacaactaatggatactggccttaatacctgggtgatgggttgatctgtgcagcaaaccactatggcacacttttacctatgtcacaaacctacacaccctgcacatgtacctcagaatttaaaagttgatattttttaaaaaaagaaaatatagacttctgtaggaaggagtttggtgctgtctactttgtgcagttcctgctactaaatagcagctaacctgtattgagtgattactatgtgctaggtatcttaataagcactatatctgaattgtttcatttaatcttcacaataaccctaaggatctaggtcctgttattttgtctccattttacaagataagaaaacttagttactcctaaggtcacatttttagtaagtggtagaatcaacatttaaccaaagttgtaacgctaagacttggattcttaaccgctagagaacacctcaatacttcctcttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcagaggtagctcatgacagaattatgaagtaaggaacaacttgtctgtgaccaccccccaccccccacccccaccttcccagcagactatcttcttggtgccctggctttccttctcttagtggtctctgaagagccagtaaactatgcagggggatttacatttgaacaagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacattgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctgtcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttag[136 bp omitted]caacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatataggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctgtttttgccttattagtagggtaagaaaaaatacatatgcaagtcctttgtcagaaattgcaaatatgttctcacactctatgcattgcctgtttatttccctataaggtgtcatttgatcaacaaatgtttttaattttaatatggatgactttattaaaaaattctctttatggttaatatgggaggtttttttggtcttgtttaagaaatatttcccttcttcaaggtcattaagatattctctgtttttatctaaaagcttgctatagttatgtatttattaattcattttatcttacacatttaaatctgcaatatatcaggaactgattttgtgaatagtatgaggtagggcgtcaagaatctttttttttttcatatgcatatgtaattgacccagcaccatttattaaaaaaggccaaccttttttcactgtacctgatcatcttttaatgggataaaaggaaagcttgttagaaatgactaggtgatagaaaatgggtttttaaacatttaggactcattagtttatttatttatttttattttcaaggtccaagaggctaaatgtgagaatccagaatttgagagaaatgtggaggtcagtaaattcaacattagctatttgggtttagacttagagcagttgggggtggagcatagcctaaatatgagctgctttgagaaaaacaaattacgttgttccgtgagttattgacaattttttcgaaaagtcaaagataatttgaattgcaatccaagtcttaatcatagacagaatttggcagataattgtattatgattcaataacagtgaaaaagaataaactggtaatattccttgtgtatttttattttatgcctaagaatacatcttgtttcatggtccctggtgttcttcctgatactttgaacacagtcagaataagagtcaaaacaaataagttatgctatgaggatgacaaactctggagtaattggagccaagaaatgagtataggtaagagaacagaatttttattaaaatttaaaacactgatgtataaaaactaagctgaagcagaaaatagactggggaaagggactgtcatgctctcttgatgtcaggaaaagagtacttacaattgaaatttattttcttcttaatcactttcaaaccacccagggttaattgacagtatacagttatttagaaaaccataatccaaatggttttatgttcttttctatctcatttccatttttattaacaaactgaacaaaaatatagaaagcaggcataggctgcacacagtgactcacgcctgtgatcccagcactttgagaggctgaggcaggaggatcgcttgagcccaggagttggagaccagcctgagcaacatggtgaaaccccatctctacaaaaaatacaaaaattaaccagatatggtggtgcacgcttgtggtcttggctacccaagaggcagagatgggaagatctcttgagcctgggaggcggaggttacagtgagctgagattgtgccactgccctccagcctgggcgacagagtgagaccgtctcaaggaagaagaaaaaaaaaaggcaggcataataaaatttgcacattgtacaatactagagactgtcctacatgctggttggcagaaacaagagtggagccatttaatagaaacctgtacctaagtttgaaaaaaatcatttattaattgaaaggctgagcaagctaggctcaagtacaggactggaaagacctgtgctttatggatgtgtgtgtggtggggtgggatacacggctttataagtgcaatgtgactcaacattgtaatcttaaatgtgtcaaaaaggcatatacaatcttaggagtgataagtgcagcacccagaaaggaatgctgcaggttggggcacagagctatggtcacatcagaattgtgcagtattccattctgagcaccacattaaaggagttgccttggcagactggaatctatccttgaaaggataatcaggatgttgaagaatctcaaaacttggcaaggaacaattggtaaagtaactttgaggagtcatgattgctgatttctaatatttgaggtattgtcaggtacaagaaggaataggctttactttttgtgtctccaaggggcaacacagaaccaacttaagaactttttaaacagctgtatattggtcaaacaggttgtcgaggtagccaattccctattaattgagaagctcaacaagttatgtgccaggcatggttgtattcgtttatttattgttgtataacaaattactccaaagtttaatggcttgaaccaacatacatttaccatctcacagtttcggtgagtcaggagtctagccacggcttagctggaggtctcatgaggttgcagtcaagctgcaatgagaactgaaatatgtctgaaggcttgactggggacagagcatccatttccaagttcactcatatagttgttggaaagcctcagtacctcactggttgctggatggaggctgttgcaggttgaattgtatctcccaaaaaggtatgttcgtaggttccaaccccggtacctgtgaatgtaaccttatttggaaataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgcttcccttagttccttgccacttggacctccccatagggctacttcctgacatggaaactggctttcccaagtgagtaatccaagcaagaaacagtgtgagagaacacgcaatatgggaaccatggtcttttataacctaaccttagaaatgacatcccattactgctgctgttctgttttttagaagtgagtcaattagtctagcccatgctcaaggagaggggattacaccagggaatgaatatcaggaggcaggaatcatgtggagaaatcttagtgactgcctaaaacaatggtgccaggccttgatgatgctttctagatgttcatgacctagtgggaaaaatgaatttgtatatagacaaatgacagtctatatgttagatgtagcaaggcaggctttggaattggacagtggaactggaatttgaggcctgatgccattatttactaaatccttccggatgacttactaaacctctctgagccttatctttctcatctgcttaaatgggagataatgctatcattatagcatatatatgagataagcatgcaaaaccacctagtgtggtatcagacatatagtaggtgcttatttaagaataatagtagttgttaggattattttaggtattttagtagtggtaagtaaccagtaaaatatgtagtcactgttaataagattacatatttaatatagcatctttgttaatagtatttaaaactagttaagatcttctgatttacctgagcgggtggggaaacccaccccatgagcatcccctgggctcacccagtgcacagagggaggcctcccgtggctgggcccctctcagtcagcccatgtggctgccatgacctggagcaccacagccgggggcgcccaccagctcaacaccaccacattcacgtggcagcacctccctgcctggcaaccgctgctgttggccagcattaggctgcagctcttcttctacgtgggcctggccttcatcagcctggacctctattactcctccaccagcatcaaggagctggagtacaactacaccggcgacccgggcaccagcaactgctcggtgtgtgctgtggctggccagggctgtgtgccactgcccatctgctcatgcgcctggtacttctcactgcctgagctcttccagggccctgtgtacccctactacgtgctgaccaacttctaccaaaacaaccggcggtatggagtgtccgcgacaacgcgcagctgagcgggctgcccagcacgctgcaccatccagtcaatgagtgcacccactgcgccgcctgcccatcgtgcaccctgcaatgtcatcaccaacagcctcttcaacgactcctcgctgtggcaccagtgctggcccggcgagccctacgtggaggtgccgcgctaccgcactgcacctgcatcacccggtagaccaactaccccatcaagttctgcaacccaccactggtcaacggcagcctggcactggccttccatggcacagcacccctgcccaactggcgctggctggtctacgacaagctcagccccatccccaacaacaacggcttcatcaaccaggacttcgtggtgtggatgcgcatggcagcgctgcccacgttccgcaagctgttccgcaagctgtacgggcacatccgccagggcaactactcagctgggctgccgcggtgtgtctactgtgtcaacatcacctacaactacctggtgcgtgcatttggcggccacaggctccgcatcttcagcagcatcttgtggatgggtggcaggaaccccttcctgtgcatcgcctatgtggtggtcagctccctctgcatccttactggctttgtcatgctggtcatctacattagctaccaggacctaccagaaagatgatgacaatgaggaggaggggtgattccagctttccaacgacccttcctgcttcttaccaaaattctgcaagcttttttcagtctctcccctttgcctctcatcctattccaacctctcctcacttttcctccctttgtgaatgagggggccagagaagggaattacccacttactcttgggggctgctaaactctgttgcctggtggcggagggttgactgcagagtgaaacatccttgcaaactctccccacctccttcatgatgctgagatgccatgttaggttctccaagtccaagagtggaagggatccttatagagactcattttcaacccctaccagaggaagagattgagagacctagcaacatcaaataactcaatcaagatcaggcagctggcaagtggttcctgacgctaaggctagagcttttgccactacagtacagtggttttcttttctttgtggggagggtgggttgggatggagagtgagacccacaaattatctgcagaggcatggaggggtgtgggagaacatatttgttaaatatgcagatagatgaggaggcaccaaccccagagattctgacacagtaatgctggggtgagatgcttgaaactgtgttttaacaaactcctctggagattcctgtattctctcaaatttggaaatcactaccctgaacctggttgggcctgaagcagtcacctgagtccagtttttcagatagtaatttgttcccagggacagtgacaccataatgttgcaggtttggtctggcactctgccttaaatatagtatgctctaatgacttgtggaatgaatttttaaaaaatcactatctctgggctgggcgccatggctcatgcctataatcccatcactttgggaggctgaggcgggtggatcacttgaggtcaggagtacaagaccactctggccaacatggtgaaaccctctctctactgaaatataaaaataagctgggcatggtggcagatgcctgtagttctagctcccgggaggctgaggcaggagaatcgcttgaacccgggaggcggaggttgcattgagtcgagatcgtgccactgcactccagcctgggtgacagagtgagactctgtctcaaaaaaattaaattaaaaaaaatcactatctctggaaaactagttggtgtacagatttgtaggccagggtttgtgtcgatttatttgatattttagtataacagcaaacaggcaaactttaccagatactgtgtagaaatttgaaaatgtgaggccagtttgtacagttcagagggaatgctttttaactgtagaatcagatagctggaagggatctttgagggaaagtaatttccctagtcacatctatgtctcctggctcagtcttctttgtcatttaatctgtgtgtgtgggtgtgtgcgtgcgcacacgtgcgtacttacaaagggcttcattcataccttttctcttggatctggaaaaaatttttttatgttttccaatgagatacatttgtagtaatcatatttgaaacaatgctaaggtatatatagtcttatatgtaaactagaatcttaacattatttgaatcttggagataatgttaaaagtcttagctaaaatgattccattgattttatcgattgactaacatcaatcaatatgtttaaagttattctaagaagcaatatttttatttaaaaaaacctttctttcatggcaaaatagcttaaaagaactttaaaaaaaaaccctatgtgatatgttccagtttatttgctaaaagcaaacagttatttggtatttgtcagacagaattcttcagtacctgctttctattatagctattttccagttaccactcattcgtttatactccttcctttaaagcagcacaagatcttgaagttttttttttatcagttaagaaatattggattgtattggatagtatacatagtttagtctgttagttctctgaaagttactgaacaatggacaatgtgcatgtcactgacatccgtctcagatcttctgggacaactatgatttaagagattctatctcattattacagataccaaaaaaatacttgggtaattccagtgtgttggctttccaactcctgaacactacacaattttattatcagtttttgtatggtgattttaggctatgaaaacattattttatgtacatagagaaatttttattatgaatgtttgagctcactagcccagccctcctctattttgaaaaagagagtttactacattttttactatgtagttgaaaacaacatgtattttgtcatttttagaatggtcagtctatttctataaaattttaaatgtggctgggcgcagtggctcatgcctgtaatcccagcaatttgtgaggctgaggcggacagaacacttgaggtcaagagtttaagaccagcctggcccaaatagggaaaccccgtctctactaaaaatacaaaaattaactcggtgtggtggtgtgcgcctgtagtcccagctactcaggaggctgaggcaggagaatctcttgaaacatggaggcggaggttgcagtgagccaagatcgtgctattgcactccagcctgggtgacagagtgagagactctgtctcaaaacaaacaaacaaacaaaagtttaaatgagaccatcaaatttaagggattctgatccagattaaattaatgaatatggttccaggtcctagtctctgagtttttgaaagagaataaagcttatgtttgtcttttaaaaaatatcctaatttcaggtaatcttttaggtatttgctcgcctagggaagttcaggcaccagaggaggactttttttttttaaactattaatttaacagaagataagataattgaagagcttgggaaaataggttgggggagggagcagaaatatttgtgatcttactagctaacagaattgctgcttggtttattactaaaagggttttatttctcaagtctttctgtttgcttttcattctccaggtaagaagcgcaattccacactctacataaccatgttactcattgttccagtcatcgtcgcaggtgcaatcatagtactcctgctttacctaaaaaggtaaggtagctgcccaggcaggttttgcagtttctgatagcctgtttgctgtggttattacttttagtgcttgtgttttatgtctgcccagtgtattagaagcatgttgcctgtaagtggctttcgggagtatgacatgacaaggaagtattaccacgcccactttcttttcttttcttttttttttttttttcctgagatggagtctctgttgcccaggctggagcgcagtggtgtgatctcggctcactgcagcctccacctcctgggttcaagcaattctcctgcctcagcctcccgagtagctgcgattacaggtgcccaccaccacgcccggctaattttttgtatttttagtagacagggtttcaccatgttggccaggctcgtctcaaactcctgacctcaagtgatccaccctcctcagcctcccaaagtgctgggattataggcatgagccactgcacccagccgctatgcccactttctaatgaaaaccatgttggattagttttccagggctccctgctcaagcactgctgcctttgcatgtgtttaggattgttgaataggtcctatgttcacataatactctttcaaatgcctaatctatcaagttagtcagtagttcttagaatgaagttttagaaatggagacctttactaataaaatgacttgtctggtattaatgcaaagtaggctactacttaatattgtgggaaagagaacttcatcaagttgtcatgaatgtatggtatccattccttgagaatattttattttctctatctcattataggactgttatttgctcttgtagtaaataactaaggttgaaataaggttattaagttggatccagaaccaatattttatcattatttcaacatttattcaacatatatatatactctctctatatatgtatattttttgagtgcctatttgtgaaccaggtactgttctaagtgctaaagttacagcagtgaacaggacaaagtcctcatctacattctagagggaaagatacacacatgcacatacacacacacacacaaaataaataataaatactataatttcacttagaagtataattgacagtagtggggtatggctaggaggtgataggaggtgcattttatgtaggatgtcaccaagaaagtgacatttgaggagagactcccagtaatgtaaaggagtgaatcattcagatattcgaggaaagagcactccaggccatgggaacagcaaatgcaaagtccccaaggctgaaatgcacttggtttgtttggctggagtggagagtgcagggtagagagtggcagcgagggaggacagaggttggccaaccacatcacgcaggccatggcaaggaactgagattttattctaagcatgatgaggagcattggagagttttgagcagagtaggcacatggtctgagttactgtcataaaggattattgtagttgctgagtgaagaactgacttgggcaaaagtggaagccgatggagtagttcggaggcattgcagtgttttggcagaaagatgaggataacctatactagggggttagcaatggagatagcaagaagtggtcagaaatagtatatattttgagagtagaattgataagacttgctgttagttgcctgtctgtggaggtgtgaaggtaattaaggattcagagatacctcttagatttttggcttgagcaactgagtgaatgctggtgccatgtactgagacagagaaggctgtgaggagagctgggtttgagggaaagataaggacttcagttttgcatatgttaagtttgagatgcttattagatatccaaataaggatgttaaataagcgattttgtgcatgaatctggagttgaagggagaggtctgggctgaagatctaattttgggaatcctcggcatgtgaatggatttaaagcctaaagaccgaaaggagtgctcataaagtgaatgagatagacaagaagacaaaaaactgaatcctggggcacatccatggacactcactgggagatggaggcaagctataagattgaaaaatggagagaagtaggaaggaaaaagaaacagaggaatgtatcctgttctcagattattcttttcaaaattatacagagcaagcgcccatctggtctgttaaaagtagagtagcatattatttagatgatagggtataagtaattcatttattctgatggtccctgtgctccacctatgggcaagagtagaacttaatgcccttagaacattgatttttgtgtaccctattttagaaatttcttcacaactgccttgtcaataaagatgacttgtgtaccatgtcttttgtccatgccttcttttaatatggtggtatttatgtgggacactcctatggactggaaggtttgaatcaaatgtctctgttttcttaaaggctcaagattattatattccctccaattcctgatcctggcaagatttttaaagaaatgtttggagaccagaatgatgatactctggtaagaacagatttcatggggcttgaaatgtttttttttttttttttttttggaagctatggcattttttaaaaaagtgtggtaaggtatccataacataaaatttattattttaagcatttttaagtatacagttcaggctgggtatggcagctgacgcctgtaatcccaacactttgggaggctgaggcaggaggatcacttgagcccagcagtttgagaccagcctggacagcatgccactgcacccagctaatttttatatttttttgcgagatctcatttccacaaaatatataaaaattagccgggtgcagcggcatgcacctgtggtcccagctactcaggagattgaggtgggaggatcccttgagcccaggagttcaaggttgcagtgagccatgatcatgccactgcattccagcctggatgacagagcgagactctctaaaaaataaaatatatatgtgtgtatatgtgtgtgtgtatatatatatatatatatatatacacacatacagtttagtgtcattaaatacatttataagttgtacaaccatcgccactatctctttccagaaatttttcatcatcccaaatagaaactgtggctgttaaacaataattccccatcccctcattcctcccacccctggtagcctctattctacttcttgtctctatgaattaaatattctagatacctcctatatgtgaaatcatgcaataatttgtccttttgtgtctggcttatttcatttaccataatgttttaaaggttcattcatgttgtagcatgtatcagaatttccttttgaaattggttcttctaaagtacaatttatttttaaaaatttgaaggagagctgatttaaaatatagtatctgaggccaagcataccagttaaaaagtcttcagaatactttgctcatcttatataactgggctccattctctctctggttaggagacatattttatcaaaacatgcaggaagaagggcctcctttatgaagctagcctaatgagcaggccttctgactcttggataatttaaaaaacttgatgtggggaaatataaacatagggtaagcaattgaaatgcattgtgttcatgttgtttcttggaaggctagactccaaagatatagaaatggagcagccctaccccaactgttatagttggtttcctgcagattctcatgctagaatttgtggccagaaaacctaagacattatgggaacaaaagggtttgaggcttctaactttagttggatttatcatccaccctactgaaataataaagacactaaatgaaataaatattattatcattgtgtatatcttaaaggaataataacaagcatagggcagttaatttagggaagtagtactgcatagtagataatagcctgatttctggagtcagattgtctggattcatatccctgctgtgtcatttaccatctttttgaccttggataattttcttagcttctctgtgactcaattttttcattagtaaaatggaggtaacaatagcacctgcctcatagtgttgttatgtggattaacttaatacccaacagttaattgaatggaaactgcttagcctacctggtaccttgtaagtgcttaataagtgttagtgattagtattactattgataataatttatttttatctttaattcccaaataattattgtaataatgggtgattctcaatggtagtgatgatatttggttagggaaggaaggcagagaggcaaatatgctatcagaagaggattcatttggatcactttttaaccaggtcatcttcacagacagtagataactctgccagaccctgggagtcagggcatgtagacccagaagttaggtacctgatgaggaaattgtatgccgtatctggagcgagtatgatagctatggttctccaactttagttgagtcacagtcaactggagtgcttacaagaaatacagatttctggaccctacttccaattccctgacctgacctgatttggcaggtcagggacgagttctaggactctgcatatttaataggagcccacagatgatccctgtcctgctaagagagtctgtggaccacactttgaaaatcagtgataaagatatttacccctgtctcttacttcatttcaccagctgtgatagatgctggaggttgggaattgtacaagtaccctaacaactttcaccagctattgaaagtctactatgtgtcagacaatgtattaagtgctttgcctatattaccttattgaatcttcataaccaccctatggagaagatgctgttggtattattttacagatgaggaaatggagccccaatgaggttaagcaatttagctgcagtcacacagctagttggtggtaaggtagaatttgacccagggctgtcttaatgctagacttctcttggtctttctactaggctgcattgcctcttgtaagatagaatgcttgttctgaagaacctcaccatcttctaagacatctgtatgacagaagtagagggttggcataggggatttctgagaaaaagatttagggttgtattatgaatagctttaaatgggaagatattggcatgtcttgtatatattaatggcacttttcatgcactgctggtgggcctgtaaaatgatagatatcctttctggagggcaaactggtaaaatgtaacaggaatctttgagcctatgattatacttttaggaaccaattttgaggaaatgatccaacaatggcacaagagtggtcaatgcggcatttgcttttaacatgaaaaattagaagccaatgaaacataacaattgagaattagtttaaaaaaatatgttaggttttcaaagcatttaatgttataacaaaatactcaaaatacaggagtaagaaacttaccataaacatgtagtatattacaatcataatttttatcaaaaatgcattaatatatacatagaacgaggggaaggaaatgggtccgaatgaatgatcatttctaggcaaagggattgtgggtaactgatattactctctctctacctttctaaaatttccagattgcctatagtgagcatgtactacttttataataaaagaaaccctgtacaagtcattaagggaaaaagaaaatactgtagtcatccaggtctgagagataataggaacttgaacttaggtggtagcagaggagattgacgtaagagacattattaaaggaaatcaactcattatgacttggtgagtctgtgtgggtgatgagaggtagggagagtaaaaaataatttcaagttttcaagtctgagtaatagagtgaatgatggtaacattgacagcaaaatcagatcaattatctttctcagagatgggaaaattgcttttttcaatttgctgtctagaggataatatgttgtttttgtcccgatgagtcagataattctgtaatttggtgacgcaaatatactgacaatatggaccattaaaagcacaaggtatttttgttttgtccattgcagaccattaaacaaaatcagttctttaaaactaaaagtataataaaaattccagatatggggaagggtaagagaacaaatttttatgtcggcttttaaccaaatgaaaaaaatctgctttcttcacatggcatcaattctcacaaattgaactgcatatgctgcatactcttttacttctagcatcattgaattattgaatgaacatagccctagaggtcatctaatgaggtggatgttgacatgtttaattatttccctttaattataaatgttcaaaactcgagattctcactcatctccctctctttagagatggggacatgaggagccacagagaagtttctcaaggactgtcactgtgttaagccaatcttgtattgctataaagacatacctgaaactgggtaatttataaataaaagaggtttaattagctcatggttctgcaggcttcacaggaactgtggtgccagcatctgcttctggtgagtatctcaggaagcttacagtcatggtggaaagtgaagggggagcaggcatcttacgtggtgagagtgggaacaagagggggtaggaggtgccatacacttttaaacagctcttatgagaactcactgttgtgatgacagcattaagccatgagggatccacccctatgacccaaacacttcccaccaggccacacttccaacgttggggattacaattcagtatgaaatttggcagggacatatatccaaactgtcagtcacatagagaggcaactgcaaaacctggactagaacccatatagcccaaagttaccaacttccaatccaaataaataatcttgtccttttttaaacactgtcttcttccacactgcaccattaatagttgttcttataaaaacttatttagttatggccatgaataagttaaatcttcagtatagttttccttaaagttactcgtgttttgatgatgttttgttcattactatagtaatgttttggccaacagcatttctttctgttgctttgctatttgccttttccttgtgactaattgggcttctggccatattgaggggaggtaaggggagttgcagagggaattgcttctcctctctatctgcatttctcttatccataaaaaaaaaatctgtcctccccctgcttcttggaaaccaattcttattttcagcattgtgccatttttatattcttgttcagaaaggagctttttaaacatggggataacatccaaatactgctgattgttattttttacttcagtgtgtatcttttttttttcctttttgagatggagtctcattctatcactcaggctggagtgcagtggcacgatcttggctcactgcaaactttgcctcccaggttcaagtgattctcctgcctcagcctcccgagtagctgggactacagatggtgccaccatgcctggctaatttttgtaattttagtagaaatggggttttgccat[138 bp omitted]agccaaaatagcattactgtactttaaaaattattaattccttaatttcatctaatactcagtccatattcaagtatttccaactgcccaaattgtcaggagacagatattatccagtcatctcaccactgaccactaagacagtggttgagattgaccactatatttaaggtgatacaacagcatgtcccctcctgccatctgcacttatttccccattgcttcaacacagataatctgtgtagtgttatgctagcaccttgtcaagtcttcagctaatgctttttacatcagttgatatccttgcttgaatcagtaatttccttaggggttgggttgaatattacagtttttctctttctatcatttctacatttacttttcttttttttttcttttgagacaggatcttgctctgtcaccgaggctggagggcagtgatgcaacctctgctcactgtagcctcgacctcctgagctcaagcagttttcctgcctcagcctcctgaatagctgggactatagtcacgtgccaccacactcagctaatttttaaatttcttttgtagagacaaggtctcactatgttgcccaggctggtcttgaatttctaggctcaagcgatcctcttgcctcagcctcccaaagtgctgggactacaggcatgagtcaccgtgcctggcccatttctacacttattagctgacaggtatctataaagcgctgctttcagtcatcaactgagctctttagttgttctgaaattcagttcctactaaaaaggcaagatgcatatttaatcatttccctttatttatccattaaggtgaggagttggattaatagacacctcatagtaccaagttattcctctccataccaccacattcaacttggtgtttttttgtttttgctttttttttttgagacagcgtctcactgtgttgcccaggctggaatatagtggtgcaaacatggttcactgcagcctcaacctcctgggctgaggcaatcttctgatctcagcctcccaagtagctgggaatacaggtgtgcactaccacgcccagctaataatttttttttttttttgtatgaatgggcttttgccatgttgcccaggctagtctcaaactcctgggctcaaatgatctgcctgccttggcctcccaaagtgctgggattacaggcatgagctaccgtgctgagcctcaacttgttctttttcaagttgcaatgattttaaggtgtggagatctacaattcattttgtataactttctgttttgaatgataatctgaagagagactggggcatgaaataggtagacttgtataccaaaggccagtgtttttgcatggggctaaggtacatgaagctcacttcacttctgtagacaatccactctggaaaatatcttaaccaaatcttgaaagtaatcttaagttgagacttgatatttcattgtactaccaaatttatgcctttaaattataaaaacctatataacatgccgtttttctaggctcacataattaccaactaaaagccagttgtgtaagccccctaatcactgattttcttcatctatgatgtttttcatctttggccattactctgttgttgattactttgtttttaaaattggcagtaaggattgaattttgggctggtaattgtgtggatttgtttatttttttctacaagtggttttaaaattagacaggcatataattcacagaattgaataataggaaagagccattgcatttatttcttttaccttacatggacatattcatagaagcagtactcaggaaaaggccactgtgttgataaagggtggaaatgagagtaattcaaattttggggatgaaaaaaggcaatcagaaagattaatgtattctgagaagccctttctgttgtagtgttcacctcattaaaacaaattgcttttttcttgtccagcacagccaagtgttggtctaatgaccggaaacaaaagtaattttcagggtgcatttttaatagttatacagtttttatttgtgaaaaatccatattacacacacacacacacacacttcaccactatacattcatgcattttttaaattaaaactttttttttttttctgatcacttgggaggatgaggcaagcggatcacctgaggtcaggagttcgagaccaacctggccaacatggtgaaaccccgtctactaaaaatacaaaattgaccaggcatggtgatgcatgcctgtaatcccagctacttgggaggctgaggcaggagaatcgcttaagcctgggaggcggaggttgtaatgagccgagattgagccactgcactccagcctgggcaacaaaaatgagactctgtcgccaaaaaaaaaaaaaatatatatatatatatatacgtatatatgtatatatatgtatatatatatatatatacgtatatacacatatatacgtatatatattcttttaaaagcaatatacatttagtatagacaaattagaactacagatagtcaagagagaaagacaaaatcactcttaatcctgtcacccagatataactatctttaatggtatgtgaacaacatagggaaactgaaatacctttagtgataaatggagtaatagcaaccacaataataatagttcatacttatggaacctttactatgtgtcttaataacactgtcatattgaattgtatttgaatgtaacaaatgagaattaaaagaatttctgaacttttgatataaaataaattttaatgatgattgaaaagatatttttccatatgctctccccatttgctccccatttttatagttgttgaacatctccattgtgtcctcatatagagccctcatttagtcttacttcagtgtgtggagatacacttgatgctcactaccattttttatgtcaacattgctccagtcatttgggttgtttgaagctggaaagttttctcaggaagtattcatgggaccggcatttcctgaattatttacaaattgatggaatttgctacatttatcattgaaagtcattttggcaaaatataaaatccatggctcataggtcctgcgttgcgtatcttaaatgtgtcatccattttcttctggcataatatgttttgtcagagtcagcagacaatataattttcctcctgtattaaaacacttggtctttttggctggttgtcaaatgatttttttcttcaaagtccaataattttaccagaatatgtgttggcgttgtgattttttgcagtgtatggtgtgctttctcagtatgtaattttagatctttttttttttaattttagtaaaagtttcttcacttacagattttagttattctcttcccatgttttctttgacctttcacatcttttttgttttggcacagggtcttgctctgttggctgggctggagtatggtggcaccatgatagcttattgcagactccaacatctgggctcaagtgatcctcccaactcagcctcctgaatagctgggacaggcatgtgccaccatgcctggctaatttttaaattttttttagagatgcagtcttgctgtgttgcccagtctggtcttgaactactggcttcaagttattcccccacctggaacttccagagttcaggaattataggtgtgagccgctgcacccagcccttccagccctttcacatcctcttgaataattttcatccaccttcatttcatttttgttaaaaaatcctactttttaatctatttaagatcttatctgatgatatgttgtgtttatttgccctgtgtttcttctagcttagtcttcaattttgaaatgattattttcctttacttttattttgttttattttttgagatggagtctcactccatcgcccaggctggagtgcagtggtgcgatcttggctcactgcaaactccgcctcccaggttcaagtgattctcctgcctcagcctcccaagtagctgggattacaggcacatgccaccatgcctggctaattttgtattgttattagagatggggttgcaccatgttggccaggctggtctcgaacccctgacctcaagtgatccacccaccttgacctcccaaagtgctgggattacaagcatgagccactgcgcccagccttcttttacttttaattcttctgtgagttttgtcatccaatttctgagttgtttatattgacttttaatatattcttctacattgattactttttttatatcatgtaactttttaaatatacttcagctagttttgaaatattaggttgtagttttcatctattttgtggatatatcgttctgttatgttttaattctgtaagagtattattctgtggctcatttttattttattctttaattttaaacattttttattttaaaaataattgtcactttgggaggctgagg[131 bp omitted]gaggcaaggagaatcgcttgaacctggaggcagaagttgcagtgagccaagatcacgcctctgcactccagcccgggcaacagtgtgagactccatctcaaaaaaaaaaaaaattattatttttgtagaggtggggtttcaccatattgcccaggctggtctcaaattcctgggctcaagcaatcctcctgccttggcctcccaaagtgctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgtccacattcactcttactttgaggttcatgggggaaatgttttcatcttgttttgttgtagatttcatcttgtgttggtagattttggatttactttcctattgggggaaccagcccccaatatttcaacgtaagttcttttctattttccctaagtgtcagccggtctgataaataaagggaaagagtacaaaagagagaaattttaaagctggatgtctgggggagacatcacatgtcagcaggttccatgatgccccctaagccgtaaaaccagcaagtttttattagcaattttcaaaggggagggagtgtacgaatagggtgtgggtcacagagatcacatgcttcaagggcaacaaaatatcacaaggcaaatgggcagggcaaggtcacaaggccagggcgaaactagaatttcgcctggttcctggtcctgctgtgcatgcattgtcattgataaacatcaggaaacagggtttgagagcagacaaccattctgactaaaatttactaggcagaaatttcctaatcctaataagcctgagggtgctgcaggagactagggcgtgtttcatctctatctatgactgcataaggcagacactcctagagcagccattttagaggcctcctcctgggaatgcattcttttcccagggctgttaattgctaatattccttactggggaaataattcagtgatatttctcgtacctgtttttggcaataagagaaatatgactgtcctgcccggctccaggcagtcagacctaatggttatctcccttgttccctgaacattgctgttatccttttcttttttcaaggtgcccagatttcatattgttcaaacacacatgctttatgaacaatttgtgcagttaatgcaatcatcacaggggcctgaggcgacatacatcctcagtttatgaagatgacgggattaagagattaaagtaaagataggcataggaagttataagagtattgattggggaagtgataaatgtctatgaaatcttcacaatttatgttcagagattgcagtaaagagaggcgtaagaaattataaaagtattaatttggagaactaataaatgtccatgaaatcttcacaatttatattcttctgtcatgacttcagcaggtccctccgttcggggtccctgacttcacgcaacactttcctatttatatttccaacttgtgtttttttatggtgatatttgggaatattcaaaaacgatgctgctaccaccatcttcttcgcagaatttttctgcaaactatagaccaaggggcaaattctgcctgccacttgtttttgtacagtctttaacctaagaatggtttttgtgcttctaaatagttgggaaaaaaatgtaagaatactatttcatggcacatgaaattaagatttcagtgtcatacagtttcgttggccaggcccattcatttatatattgtctgtggctgctttcatgctacaacagcagagttgttttataggcacagagactatatggcccccgaagctgaaaatacttcttatctagccattttcaggaaaagttagtcaaccctggtcccctataatatagtttttagtggctaaataatattccattgtgtgcacatattataatgtacttaacaaaattcctattggcatttggatgaatcctaaatttcattgtataggcatcatttcacagctaagtataagcatatgtattaatattttattactgtcttaggataaattgttacaagccaaattgcatgatcaagggggagggtatatgtattttaaactctttgactgatacaggctgagtattcctaatctgaaaatctaaaatccgaaatgctcccaaatctgaaactttctaacatgacgttcaaaggaaatgttcattgcaacatttggaatttcagatttttgcgttagtgatgctcagctggtaagtatatagtgcaaatattccaaaagctgaaacacttctggtcccaagcattttgcataagggatattctacctgtattgacaaattgtcatccagaaaggttgtacaaattaaattcccattaaggaaactggctaaataagttatggtgcattcatgcaatgaaatattatgtagaggttaaaatgaggtagatcacttttactgatgtataaaaatataacatacactgttaggtgaaacacccaggttacatatggagagtatgattcctttgtgttaaggaaactggggcattaaaatgcacaaacaaattttttcataagaagcatagattacaactaagttgtgccagttcatatacctaccagcagtatgttcgactggttgtttgaccatacttttgccaatatgatattacctaattttaaaattcttgccaagttaatagatgagaaaagagcgtcttaattttacagtcaggttttgtactttttcccaagtttattggcttgaattaattcttttgtgaaattcttgttccacgtccatttttccttgttgtattcatcttttggtggtttgtaaagctctttacgtattagatattaaccctctggcttcttatccatgttttcctttgtattgtatttagggtgattaatgatgtacaaaaggtttttccttttttatgcagtcaaatcttcctgtatttttaggtgtaaagagccctttccaccttagatttatatagttgttcctctacatatttttctagtacttatttgattttttttaacattgagatctttaatccatcagggatttattcatgtaggctatgaggtagggtttagcattgttttcaaatgcttatattacccacttgtcttagtgtcatttattaaataagccattttttcaaggttatataattttttcaaattgtttttattagaaatctatacatttcacatgttttaaaatcaagtttgaggtgtaatttacaataaaatttactcttttttgagtgttcagttagaagaatgttagcaaatatatgcaattttgtaaccactgctccattaaaaatatagaatatttccatcatctcctaaaagttatcttgtagtcctttgcagtcaaccccctctgttaatcgccttgcaaacactgatcagttttctgtccctaaagtcttacaagatgtcctataaatgaaatcacacagtacatagctttttgagtttggcttcttttactcagcataatgtgtttaagagacatccacactgtggtgtgtgtcagtagttcatttccttttattgctgagcagtattctataatatggttgtaaccacagtttatttaaccattcacttgttcaaggacatcagagttgtatctagtttttaatctattattagtgaaaatgctataaacattcatgtagaagtctttgtgtgacatgttttcatttctcttgggtaaatacctgggagtgggatttctgggtcatgtggtaagtgtatgtgttattttataaccaagtgtcagactgttttccataatgattgcactatcttatttttaccaacaatacatagagatctagtttctctgcgttcttatgagcgcttggaattgtcggtatttttaattttagccattctagtaggtgtgtcagggttatataatttgtttagaataatttgcatattttgagcagtgtttcccaactcatcccctcatctcttaacttgcccagtccatcttcagttgcacaacctgaggcagctcttgtttctgtttttcttctttccatttcttttctaagaacatctgtgcagaaaacgagcttagacataacctaatgcagggtttggtagacttttttctgtaaagggccagataataaatgattttgtttttgcaagccattcagtctctgtcacaactcaactctgccattataacatgaatgcaggtgaaggcaatatgaaacaaagaccagcattcagccggatttgacctgtggaccatagtttgctgacccctggtttagtataacaactttattttacagatgagaggaccgagctcatgtttcaccctttcctctgatttacaagtaaaagtaaaaaaaaggcaaggaccaggatattggcttttaccataagagacatgcttgaattgggttcaagataagtgtgctttatgtgtaatttcctgttctagcaaatgatgttagatgaagctcttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaatgttttcctttggtcttattttggggaaatggtgggaggtagagaaaattggagttaaaagaagaaacattatgaaaaaattccaagccagctattttatcttataatcattcatcatgagtttctttgatgttctggctgttccggtgtgcctatgttttctgataagggcataaatacacttagtttaatattaatttagcctttgtaagcagcacttgaagggacttaagtattcaataaattgtagttatgataattaatggaaatggagggttggtcctttctaatattaagctaaagtggaatgcaatatgattaatgatatacatgatgtgcaatgtctagtcacaagggaatat[131 bp omitted]taacacggtgaaaccccagctgtactaaaaatacaaaaaaattagctgggtgtagtggcgggcgactgtggtcccagctactcaggaggctgaggcaggagaatggcgtgaacccgggaggtggagcttgcagcatgccactgcactccagcctgggcaacagagcgagactccgtctcaaaaaaaaaaaaaaaaaaagaaaaagaaaaaaaaatcagttttcaatagctgtccttttaaaagctggtgatacagtttcatattttctataactacagcaaaatggttttaatgtcatggaggttttcttcccctcatttgtgttaagctcaaggagtgtgtcttcagccagatcacatttgctaattaccctgaatctttatagaatccaaaccctagggaaagagtgagggtgctgatcttggtcaagttatttatctggaattatccaggaagattctgaaaatccgtttctaggtaagtgtagctgttttgttgttcttgttattttaaaataagaaacctcttttctgattcttaacacatcaacagtgagtattacaacagaaaacatttaaaattgagaacccccttgaggtcgtaaatttgtgtgagatctatggaaaacaaattcctgtagccacaaacatgatcactttgtctcaggggtagaggagccagagtgatctaagcacatttgatttccagaggaatttatcatttccttgtttccatgaactcttgctcttttgaaggtgtaacttatgctcacatgaatagcacattatgctactaacttattagtagttttaaaagaaagcaagaggacaagaacatttatttcagagactctgttttcttttaaaccctaacggttgagtcaaacaaagtcttttttgtaaatactgtagctaaatcttggcatgcttttactttaagcaagggaggagttttactgacatttggatgtgctagatatttttgacatcaatccccaagatgatttcttcttgaaggttctctggctttttactatctttcctaacggtcacatttttagtttaccattagcaacaggaaaatatttaactgctggttttcagcatttattgggtagaccattataaaaagaaaattaatagtttctgagtggctcctatgtgccgagttacatgtgtgatttcacataatctgtatgctggtcccatgagttaggttgtgttgttaacgtcattttacagatgaagaaactgagacatagagcgattgagctgtgtatgcaagatcacatagctagtaagagactaagacaaaattgggaagcaagtcagcctgactttaaagcctgtataatatagtcagtggtatatttacttgtccccaaaaggcagttacctaaagaaaaaaacatcttatttcgcattttgccaaattgcttatcaactggaagatttctgattttaaatcattaattgcaaagtgagcattttatagcatcttttttgttttgttttgtttttttgagacgggattttgctcgtgttgcccaggctggagtgcaatggcacaatctcagttcaccacaacctctgcctcccgggttcaagggattctcctgcctcagccccccaagtagctgagactaggtgaccgccaccacgcccggctaatgtttgtatttttagtagagatggggt[147 bp omitted]tacgagctagacaatgtgttatgtaataggaatttagaagtcaataagatttggcttagtatcaggtggttagttaagggaaggctactttgtataggggaaagaaacctggattatcatttaggagttccaaatgaatgtgggcagataactttctctgtctgggtctgtttccctatctgtaaaatgaaggtgttagacagtgatgtataatcccatccatgactcctaatggtgaccataggttgtggagttcatttggaagtgagaatctttgctataaacactagctctaggcatcagcgttctcatctgtaaaatgaggaggttggactagattagctctattaattttgacatccaataaaggttaagatgatttttgttttacaaatcaagaaaatacctcttattcactacaggatgtagcgaaactgccaaaaataaccagaggagcaggccctttaatgcagtgggaagaacaaaggaattaatacattagatgaaacctgtggtctacccaaatcaggattttcacaagggcccagccatgattgcatctaacaaatatttcttaatatgcatgtatgatactttaaaagccaaagagtattatagggcttatcatttaaaaaaagcagcctcctgtcccactcctccttacccctgattcctgctcctagaaaagatgtcaacaccctaattctgggacctgtggctatgtaactttacatggaaaaaggaactttgcagatgtaattgtggttcaggccttaagatagattttcctggattatctgggtgagcccaatatcaagcccttagaagccgagaaattggctgctttggctgaaagcagaagagggagaaagagccaaagcacaaaaagggctcaaagtgctgttgctggcttgaggatgtaaggggccatgtaggaagtgtgagaaggaactggatactaccagtaacttgagtgggcctggatgcagattttctcccagagcctccatataggagcacaagctggcagacaccataatctgggccttgtgagaccctgagcagagagtgcagccacactgtgctggacttctgacctacagaagtgtgatataatatgtttgtgttattttaaactacatttaacatgttttacctgtttcttttggtatataaccctttacttttgaataataccctaatattgcaatttctttagatttagaaatgatctttcttctgtagaagatgaggaattagcttgcttttatgcctctcaacacgcacttgtgcacacatactcacacttctcttccaaaaatataaatattttcgttaaaatagtcaatatttgcattatacttatataaatattgcttgtggttaacttatgcactgtaccattaattatatttttttgtttttttccccatattgtctcccctttatttttttatgtacctgtcatgagttcaatcccaaacttttccccatattgtctccctttctttgatttatttttgtatgtacctgtcatgagttcaatcccaaacttttctgaagaaccataacacttcactcaatatgatcaaacatgttaggtaatccatgagtttcatgaatttttggggggagacagccctctttagagtttgctgccctcctgatccatcctgaaatggttgttctctaggccgagcacctagctgccatcctgggaattccctccacttccagcttctgtttcctgcattcccagttgtcccccttcttggattatgccctggttttgctggaccacaccgtttactaagttccttagaaaggttgcatgggaggtgatttttatttttttcagacagggtctcattctattgcccaggctagagtacagtggtgagaggggacagcgtgctggcagtcctcacagccctcgctcgctctcggcgcctcctctgcctgggctcccactttggcggcacttgaggagcccttcggcccgccgctgcactgtgggagcccctttctgggctggccaaggctggagcccactccctcagcttgcagggaggtgtggagggagaggcacgagcgggaaccggggctgcgtgaggcgcttgtgggccagctggagttccgggtgggcatgggcttggcggggcccgcactcggagcagccagccagccctgctggccccgggcaatgggggacttagcacccgggccaatggctgcggagggtgtactgagtcccccagcagtgccggcccaccggcgctgtgctcgatttctcaccgagccttagctgccttcccgcggggcagggctcgggacctgcagccctccatgcctgagcctcccacccactccatgggctcctgtgcggcccgagcctcccggacgagcactaccccctgctccacggcgcccagtcccattgaccacccaagggctgaggaatgcgagcgcacagtgcaggactggcaggcagctccacctgcagcccctgtgcgggatccacgaggtgaagccagctgagctcctgagtctggtggggacgtggagagtctttgtatgtagctcagggattgtaaatacaccaatcagcaccctgtgtttagctcaaggtttgtgagtgcaccaatcgacactctgtatctagctgctctggtgaggatgtggagaacctttatgtctagctcagggattgtaaacacaccaatcatcaccctgtgtgtagctcaaggtttgtgagtgcaccaatcgacactctgtatctagctgctctggtggggccttggagaacctttatgtctagctcagggattgtaaacacaccaatcagcaccttgtgtttagctcaaggtttgtgagtgcaccaatcgacactctgtatctagctgctctggtggggccttggagaacctttatgtctagctcagggattgtaaacacaccaatcagcaccttgtgtttagctcaaggtttgtgagtgcaccaatcgacactctgtatctagctgctctggtggggccttggagaacctttatgtctagctcagggattgtaaatacaccaatcggcactctgtatctagctgaaggtttgtaaacacaccaatcagcaccctgtgtttagctcaaggtttgtgagtgcaccaattgacactctgtatctagctgctctggtggggccttggagaacctgtgtatccaaagtctgtatctaactaatctaatggggaggtagagaacctttgtatctagctcagggattgtaaacgtaccaataagtgccctgacaaaacaggccactgggctctaccaatcagcaggatgtgggtggggccagataagagaataaaagcaggctgcctgagccagcagtggcgacccgcgcgggtccccttccacttctttcactctttgcaatatcttgctactgctcactctttgggtccacgctgcttttatgagctgtaacactcactgcgaagacctgcggcttcactcctgagcccagcgagaccacgagcccaccgggaggaacgaagaactccagacgcgctaccttaagagctgtaacacacaccgccaaggtctgcagcttcactcattagccagtgagaccacgaacccaccagaaggaagaaactcggaacacatctgaacatcagaagggacagactccagacgcgccaccttaagagctgtaacagtcacggcgtgggtccgcggcttcattcttgaagtcagggagaccaagaacccaccaattcgggacagtggcatgatcacggctcactgcagcctcgaccttccgggctgaagtgatcatcccacctcagcctcccaattagctcggactatgggcacataccaccatgcccagctaagtttcattcattttattttatttattttttttgagacagggtctcacttttatcatgcaggctggagtgcagtaatgcgagctcggctcactgcaatctccacctcccaggttcaagcggttctcctacctcagccttccgagtagctgggactacaggcacttgccaccatgctcagctgttaatttttatttttttgtagagatgggggtctccctgtgttgcccaagctgatgttgaactcctgggctcaaacaatcctcccactatggcctcccaaagtgctgagattacaggcatgagccattgctcccagccaagatgatttttgtaaaatcattttttgtctaaatataatcttcacacatgattaaaatttttactaggtgaagaattactaattggaaacaatttcctctgagaatgttgaaagcattattccgatgtgttgttgcttctagtgttgctttagaaatgtctgatttctaattttctacatgtaacttttatctgcaaggttttctcttggcctcttttctcttggtgttttaaattttaatgatatgccttattgtggatcttcttccatttactgggctggactttgtgagccctttcaatctaaaatctcatgcttcatttttaagacattgctttctattatttctcacacaatagcttcccttgtgttttctttatctctaggattcctattagttgtacattggacatcctggactgattctgtaattttcgtatcttttttctcccatgttccctttatttgtcttttggttctgctttttgggagattttcttaacttgatctacctgaggctcagtcctcatctgtaaaatgctgataaaaggacctaccacctagcgttgctgtgaggtgtcagtgaaataaaatgtaaaatgcttagcacagtgaactttaataaatggtagttgtggttgcacatactgttattctggaaccaatttcttgtccctcctcatgtgaaaatgacaatcttggtttacaatatcatactataatatttgccttcattgtagtgaatttgtaatgacatggcattttccaattatactgtttttagaaaaaaattctatggtataaatccagttagcaacattaattcttatttatgcttctacaaacacttaaaagtattttttttcttttttcttttcttttttccactctcccctcatccctggggtagatgagaactggaaaaataatgctgggtatccactccctgacagtgaaataggtagtttggagccccaattaattactttgttaggatgagagtgcagatcaaacctttaacatgtgagggttgccgtacactctgcctgctatgcagccccaaataaggctggccagtacctaggagcactgaggaggctaatggacaattaacaaacatcgagtccagaggaggcctggattctctgtaagctttgcagccaaaggtggccctgcctgcccacttagggccccatgaagactagaactagaattacagaaaaagaatgtctgcaagtcaagaacaatctggctttactactttattttcattccttcatctgttcagttggggggcgatgttaaagctatgtgacatgggcaccaaccagtcaggtcagatgctggctataattacttggtaggttatgtatcaaccctggattcaacagatatttattgagtgtctaccatgtgccagcactgtgctagctaggtactgtatgatgcagggcaagtttctttctttctctgagcttcagtttgctcacttgtgaaaaaaaaggagtaagtgatctacaagggctcctttaggtctaacattcgcaatcaataaaatagtaacttttgattgttttgggaaaataatggaaacagctatagaaaacaagcagctgacctaagacttgtagatttgaaaatgggggaaaaaacagaaaattattctgagttattgtttgacttgagatttggattaagaatcagttctacatgtcttattttcatgatgtttccaaagggagacaaagatagctctaatcaaagggtgagtttgttttacagccttgaacattcaagctccaccccactatcccccaccaacatgcatatacaagacaccttccccctaaggaggctactactttcttttagcatcctctctccagctgctacacttcaaaccctttcgttcagtggttggcaatagcttgtccactctggcaagagtccatgttccaagcctttcttaacttcctcttttcagacttgtcctgcctcatttcctgttccttgtggcctctgcctcataagatgtttgatcaattcatctttgctaatgtagccaaggagggctaagaagtttgtgggttaccatttctggataaaattcatattacaaggagcctccccaaaccatgctaccacttttatggtggattaaaaaaatattatgggaaagttcaaacatatatagaagtaaggagactgttacagtgaatggtcatatacccatcaactagcttcaacaattatcaaaatggtcaatcttatttcatttatactgccacccatttcctacttcctacatgacgaattatttttaagcaagtcccagacatcacatcatttcatctgtaaatactttagtatatatctctacaaactaaggaccctttttgttttaaaaaactgcaataccattatcacactttaaaactaaacaataattgcttaatattctcaattatctagtcagtgtttacatttccccaattgtctcataagtctttttttcctacaatttgcttgaatcaggatccaataaggctcacggtgattttttaaataatgatgctttgtaatatacaggggtgagaatttgggaacaaatgattgtttggcctttaaaatcgtactacattggcatttaggaatgaatacagccctgctgccacaaagtagctctttttcccttccagattgctttgactaaaaatttgtttagcatcccattggattctggaaattcttcttgttttctcttttccttccttccttccttccttccttccttccttccttccttccttccttccttccttccttccttcctctctctcttttttttcttttttctttctttctttctttctttttttttttttgacagagttttgctcttgttgcccaggctggagtgcaatggtgcgatctcggctcgctgcaacctctgcctcctgggttcaagtgattctcctgcctc[133 bp omitted]tcagcctcccaaagtgctgggattacaggcgtcagccacagtgcccaacaaattctggaaattctttataagcgtagtcagacatctgtgaaggaagtgaaaactgaagtttggccttgaagcttagaagttctcacacaaccaagacatagtcttccttaaaacagaaaaaaaacacagccatgcatacacacacacacacacacacacacacacacacacacacacaaatgccaacttctaatatgtctacggaatgtttttgcaaatggtagtacagagcatatctgtgttgtgtaattttttcccacatgataaggaccaatataaacaaattggaaatgtgatactaaaagagagtacttcagcatggattaattaagaccaatatggggcaatccttttctgatattttacaatgcactgaaaattttaaagcaaggtggaaaaataggcttatgggtctgaatgttaggttgagaaaaattatctgtggtcaagtgtgtgctttgtaaatctgctgagtttacacttgatcatgcagttttctataagttgctggcttgaataccactgggaaatatacagaccatgtgactatgaaaccaacccaattgtcccacagagctgatgtttctgatctctttgaataaacatagaaattgatccttccagtcttaaaacttgagaaagttacatttgtcttatctgaattcctttctcaggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaacattactacagacctctcagaatggctaaaataaaaataatgacaacacctcaataatagtaaggatgcaaagaaatcatatcactcatatatttcttgtgggtacataaaatggtacagctactctgagaaagagtggcagtttgtttaaaaacgaaacatgcaactatcacatggtccagcaattgtactgttgggcctctatcccagaaaaataaaaacatatgttcacacaacaaactttacataaatgtttataatggttttattcataatttacaaaaactagaaaaactcagatatccttcaatgggtgggtgaatggttgaacaatttttggtacagtcacatcatggaatactacttagcaataaaagtgaatgaatatcacctcacgctcattagaatggccactataaaaaaaaacccataaaatagaaagtgttggtgtggatgtggggaaatgagaatccttgtgtgctatttgtgggattgtgaaatggtgcaacagccatggaaaacagaatggtagttcttcaaaaagttagaaatagatctacctaggctgggtgcggtggcttacgcctgtagtcccagcacgttgggaggccgaggtgggcagatcaactgaggttgggagttccagaccagcctgaccaacatggagaaaccccgtctctactaaaaatacaaaaattagccgggcgtagtggtgggcacctgtaatcccagctactcgggaggctgaggcaggagaattgcttgaacctgggaggcagaggttgcggtgagctgagatcgtgccattgcactccagcctgggcaacaagagtgaaactccgtctcaaaaaaaaaaaagaaaaaaagaaaaaaaaaagaaaaaagaaaaagaaatagatctaccatatgactcagcaatcccacttctgggtatttatgcaaaagcattaaaagcagggtcttgggatatttgcacacccatattcatagcagcagtattgaaacatggagtctgggagcagcattcctatgatcagtgtctatgctattccactttgtgcttttattaattcattcaagaaggcttttgacgaatatagatcgtgtacgagatgctgtagtagattcaaagaatagagcatgctttcttttcttttttaaaaaattgagatggtgtctcactattttgcccaggctagtctcaaactcctgggctcaggtgatcctcttgcctgccaagtagctgggactacaggtgcagtgcatactttctgtcctattattgctgatagtccagtgcaggaatggcaaatttgtttccttttgtggatcagttcttctggaatactgtttcccgaaggattttgagattgggtttgggctcagtgggaagatggctaagatctatcagtgatgtctcttgttgggtactggtgggggggtgttgatgtacttgtgccacatggttgccaccttggctaagggctagagtgacatatttatgtatataaataatggattatcaacaagacagaatattagcaattagagttatgaaaggaggtccaagtaaagtgctgtatacaggcagtggaaaaaatgatgggggtgtcggggctgggaggatacccagaaaagttttttgagggcagtgctagttggtctgcacattaaagcaagagtagaatctgaagagattaacaaaagggggcatccctgtcctcagaaggagtttgagtagagtggaaggatggattgtgagagaaagatgacagagataagcagatgacctagggattaggcaagaggtggagaggatccgctccatgcctggcaaacaggagaggaggacacagatctgaagtagtttagaggttgactcaccaggactccatgaatgggagggagatgctcaaaatgttatagagaagcacaggcttgggtggggaatggggagtagatgagaaatacgaatttcattttggacatgttcactgtagtatgctagaggaaccattaggttatgatttcctacagggttggggacactcacggatggcaatgagaggagggcagcttcaagagtcagggttatgggagccagctgccagggaaagaccaatgaggtcattcccaaaataagacacattgcaagccctctcagcacagtgtgaggacaacccaaatctaagctagctctgggggcagtcatggcatggtaggttagatgtcaaagcagagacttcatcacgaacttggcagcccaagagtaacacactgctgccatctgggggctgcatgtagaaattgtaatggcagctttgtgaaagccacttaatgagagaggacattattttggaaccagcaagacccttcctctcaaaagccttttatagttcttccttaaattcttttctgcctagttctacttctctgtccccaatgaaggaaaccatgggtgcacatgttctgtagcatatttccagaaggactgaacccctgaaagcagaatactttcagtcagctacagcatcctagcactggattgagatactccatgctgctgctgctactgtgctctagcaactgaccaaagttcttgcctgaaccaccctctgccggatctcccaaatcccctcattttgacttcatcactgcctggttctgacctttgatactagaatactgaatttttgcctccaggggcacaatttactcttctatgttttcttttgctagcatctttttcctaagtggaactggattttcatttactcatttttcattcaacaaacatttattgagtggccacagtgtgtcaggtactaggatacatttgggagcaaaaatagatgggtcccctcagaaacctgtattacagtctaactgtaaagacaaaacaatcattttaaatgtgataattgctatgaaggaaaggtcaatgatgcagtgagatgtagtgaggtgagatgaagaaaaggtcgatgaggctgtgagaacaggtaacaggggattctgacctagtcttgcagggtagcaaaaacttttctgaggatgtgacatttaagctgaaattttaaggattggtaggaattagccagaaattaactgttctgaaaactatgaaacctataagactgggaaagaaggggccatcctccttgttcctctgtcttctacagtggtaatacagcagggagattcaattgctttacataggacagtctctaggaagatctttcattctgaattagcatgtcaactacagtgaaaacatgtctaaaaaataacaattacaacaactagaaaatcaggaaatgtagaaataaagaaccccccctaaaactcctccaaattagactgccctaatgaaaataggaataggtataaacagacaaagaaatactaatgttcttgaagtcttgaaatactatcttttggtttatttcttttcatttttatttttcatttaaataattgaaccgattttttattttttgagacagggtcttgctctgttgctcaggctgtggtgcagtaatgtgatcacacctcactgcagccttcaattcctgggctcaagcaatcctcacacctcaacctcctgaggagctgggactacaggtgtacaccaccacaccaactaatttttttttttgtatttttagtagatacaggattttgccatgttgtccagactggtcttgaactcctggggtcaagtgatctgcctgcctcagcctccaaaattgctaggattacaggcgtgagctgctgtgcccagccgaactgctttttaaaaatctccatatacacttatttgaacaacttgatcataatttctgaaatcttttaacacatcagacctgaaccaaatcaagataccaaaacccacctgagcttcagatgcctcattggtaaaatagggattatagtatagtaatagctacatcttacggcttttggagacttaatgagttgacacttacaaagcacaccattgccctgctcattgtaagtgcataatacatgttaatattattattccagggctgacctgtttgtagaaggtgtcaggggaaaatatttccaggttgatggaacgttgaggttgcttcaaccccatgccatggttggttacttcagctacgcaaggaccagccccgacatgagaaatgataagtgaaaaaaagagaatcaagcccagtacatagcatataattcacctggcctgcagaagtacacacaaaagcttattctgtagttcatattcataagagatatcccctccctcgttcctaacaggtaatcgtctagtctctgcctaaatccctgcagcaacagggagtgccctatttatggagaaaggccattttatttattgatagttctaattttctggatctatcttcaaattccagagtaaaaagtcatttttatcatgtatcttcccattaatcttccttatgccctggagaaccaaacagaacaaaaaaagtcctcactcaaaattggcaaaattgagtaaggacatagattacaatattgcatcaactatcaagtgtcctaattttggtaatggtcttctataagaatggctgtgtccctgggaaatatgcattgaagcattagggagtaaaatggcatgatgcatgtgacctgcctgcaaatagttcctaaaaaaaaagaacattaatatgtaagtaatgagagagagtgataaaaacaaattgccaaaatatttaaaattggtgggatctgcatagatggtgtatgggaattatttgttctacttttacaactcttctgtaatttttaaattatttctaaataaaaagttaataaaaatcctgggctgggcatggtggctcacgcctgtaatcccagtactttgggaggctggggtgggtggatcacttgaggccaggagtttgagaccagcctggccaacatagctaaaccccatctctactaaaaatacaaaaattagctcggtctggtggtgcacacccatagtcccagctactcgggaggctgaggcaggagaatcgcttgaaccctgtaggtggaggttgcagtgagccaaggtggcaccactgcactccagcctgggcgactgagcgagactctttctcaccaaaaaaaaaaaaaaagatagtaaaaatcctctctcttccatagcaaagctcttcaaaggtttgagagcaattaccacatttattctgttctacatttccatctcacttatttgcttactcttcactcattcatttattctttgataaatattgattgagcacttgctttgtactatgcccagagctgggcactgtggaagtggtggagaagaaagtcaattctacctggctctcatggaattcaggggcacttggtggagtccaaaggtaatcaaattattctacaagtaattgtattatttctaactctgatagggctatgacataagaatcagggagggtgggatggtatgagagagcctgccagaacgttctgaacctgctaagtggacccagcatttaaggttgtaggggtgcaaagggcagtgtgccaaagagattagcattcctttatgaaaaatctcttggctgaggggaaggatttgtgagcccaggtgagcagctttggacaagctgttccatttgtcaagttgttccatctgcttccttaagtgtcacaaagtattgaagagagattgcctgggcttgaatgacagctgctgtttcctagccatgtagttgtgaaagaggatagcagagccttggtgccttcacgcagattgagacccttgtcccccatcaatcatagctatgtctgatggcatggctatggcagttgggtcccttgccacacaatttcaagcctgggcctgagttgagcccagatgagtcctgggaacagaaactccaacaggaatcatgtcagtttctgtaacaggatttgccttgcaacctagatgagaaaactgagctttagagtcatcagcatgtattttttttcccaagaaaaatagccattaaatgtgggggtggatttgaagatcaagctgagaatgtgcatgtgaagcttagcacttagaacataatatgcctccaacaaatggcagctatcattcttttcatcactgataccaaggtgggctgagtgaagaaaaatgaggtggctgaggatgctggatatttaatacctccagggcactgtcaagggacaggggacagggctccaaatggaaggatgcaagaacttgcttttttttctttttttttttgagatggggtcttgctctgtcgccgaggctggaatgcagtgatatgatctcggctcactgcagcctccacttcctgggctcaaatgatcctcccacctcagcctctcgagtagctgggaccacaggtccacatcaccatgcctggctaattttttattatttgtagaaatgggatctccatatgtttcccaggctggtcttgatctcctggactcaaacaatcctggcaccttggcctcccaaagtgttgggattacaggcatgagccaccgcacccagccgagaacttactttcacccatctcatagttttgcttgtgatgatcacctagtattctaaacagtcagtactcgaactctagtgcaatattattcattcaatgaatgtttattgagtacttgctatatgacagacactgtccaggtgctggggctacacaaggaaacaaaacaagtgaacacttagcttcatatttctatataccatgagagttttcacagtgctttcatgtccatgatttcatctgttcctcatgacaatacaatgagataggtcctattattattttcattttatgggtgggggaactgatatatccagagattaattaattaactcaagagcgatagaacccaggccccaggttgtagtttaatgctcccttcaccacacacacattcggaacggccaccatcctgatctacctcttgccagtctccctcttgccagtgggcccccagggctttccagcctgacttctgcctctggaccccaccctcctcccccacttgctctagatcttgtctctgccacagcagtccagctgatcagtcagcaaggatttctgaagcacccagcaccatgattttaccatgatttcccaaagggctacttgggtctcagtcatttcagtcaatccagaccagcaggctggcctacattttctgaggtgttgcagctatgcagaattggttggactttttgctgggcccctctatggtggtgctttgggagggcactctcctgtgttcagataactggggcagaattagaggaattaacaaaataacagttttggatgccaggttccccattaggagtttgactctgcactccctcagatttggtggcgtgtgctctcctgctggtaatacacttcctgtgacctggaaatcctactgctatattccttaggtttggccagactttaaaacccgccagatcattgcaacttaagcaacttctaagaacatctctttaccaggtgttatttagagaacgcaagagatttacgtctgctctgaaatgttacattggcactatataaactttcccagtacacaaagctctcaggcttttggacatgttttctcctattaagtcatataaatagcttaataaaacagtatttggttaaacatcatttgaatttcccactgaatgatggttatattcaactccaagaaaacgtggaaagtgcaaaggctttggaattagacggatctgttttcaaaacattacgccacctcttaaagctgtgtgactccaggcttcttacttaacctctccgagtgtcagtttcaattacacataccatgcctgtaatcccagcactttgggaggccaagcggggtggatcatttgaggtcaggagtttaagaccagcctggccaacatggtgaaaccccaactctactaaaaatacaaaaattagccaggcggtagtggtgcacgcctgttatcccaggtagtcgggagactgaggcaggataattagttgagcctggcagacggaggttgtagtgagctgagatcacgccactgcactcctgtctgggcaacagagtgagaccttgtctcaaaaaaaatgcaattgtattattttcatgtatggtatctagaataaatggaaaataggacaataacagacatacaacagggactcagaattaatgtatctcataacgagctttagaaagaaataataacagatgccaattataaagcacttacatgtcaaaaaacatactcagctgggtgtggtggtaggcacctatagtcccagctactcgggaagctgaggtgggaggattgcttgaagccaggagttggaggccacagtgagctatgatgagtacagtgaatggccactgcacttcagcctgggcaacagtgagttcccttatctaaaaaaaatattcacaaggtattacaaggataatcttctttaatatgcacagtaacattttagctagatgatattataatctccacttacagatatggaaactgaggcccagaaggattgtgaaactaaaacttaagtggtagatgcagaacctatttggttttgctgtagagcctgcatgctttaccactatttccctatctttagtgctttgcacaggaaccaaagaagcacgtcttttaggaaagtcaaatctttttactctatccaacactctctccactcctattccctcttttaatcttacggacacttaatttaggaacccttttcttgaaatatctggaatcaatagcctggctcagtccaatattttaacaattcagtgtagtccacatacactcaggtgaatgagtttaatgttaacagtttattgaaaatagaacagatatacagaaatgtgcataaaacatgtatgtagatttttaacaaatcgttagaaaagaaatacccatgtaaccaccaagaaagatcagaaatcaaacactaggatgccacagaagccctctgtggttctctttttaatcaaagctcttctctcacccccaggcggaaccactagcctgacttttataggaatagttccatgctttcttttagtttttgatcatctctgtatgcaagtctaagcaatatagtttaggctcacctttgtttgaactttatataaatggatccacaccgtaaatattctttttctaaaaaaatctttattgtgatatagtgtacatctttaaaattcatcctttgaaagtgtacaattcaatggtttttaaatatattcagttacatgaccatcatcacaatcaattttagaacattatcatcaccacagaaagaaaccctgtacctattagcagtcactcccttttccttcctacccccaacccctggcaacctctaatctactttctatctatgtggatttgtctcttctgaatatttcatataaacagaatcatacaatatgtggccttttgtgtggccatctttcacttagcatagtgtttccagggttcacccatgatgtagcatgtaaaagcacttctttccttttatccattcattaattgatggacatttgagtggtttccccttttcggttat[137 bp omitted]ggtgaaaccctgtctctactaaaaaatacaaaaaattagctgggcgtggtggcaggcacctgtagtcccagctactcaggaggctgaggcaggagaatggcgtgaatccgggaggcggagcttgcagtgagccgagatcacgccactgtactccagcctgggcgacagagcgagacgcaatctcaaaaaaaaaaaaagtttttgtatggacataggttttcatttcttttgggtattcacctgggaatagaattgctgggtcatatagtaattctatatttaaccttttgaggaaatttccaaactattttccaaagtgactgcaccattttacattcctgtgagcaatatttcaggattccaatttctccatatccttgctaacacttgttattatctgtctttttaattatagccatcctagtaggtataaaatggtatccaattgtggttttcgtttgcatttccctgatgaccaaataatgttgagcatcttttcattggccatttgtatatcatatatattccctggagaaatgtttactcagatcctttgtccattttaaaattaagttgtctttttattgttgagttgtaaaactatatatactagataaagatccttcatcagatatataatttccctatactttctttcattctgtggattgtcttttccccttcctgacagtgtctttttttttttttttttaaactaggtctggctttgttgcccaagctggagtgcagtggcgtgatcttggctcactgcaacctctgcctctcaggctcaagccatcctcctacctcagcctcccgagtagctgggattacaagcacatgccaccgtgctggctaatttttgtattttttgtagagacgggtttcaccatgttggccaggctggtcttgaactcgtgagctcaagcaatccacacccttggcctcccaaattgctgggattacaagtgtgagccaccatgcccggccctgacagtgtcttttgatgcacaaaaattttaaattttgtgagccgagatcgtgccactgcactccagcctgggcaacagagtgagactctgtctcaaaaaaaaaaaaaaaattaaattttgatgaagtctagtttttctgtttgttgttgttgttgttgttgcttatactttggtgtcatatctaagaatgctttgcctaactcaaagacacaaacatttacttctatgacttcttagagtttttataattttagcttttatacttaggtctatgattcattttgagttaatttttgtacatggtgtgaggtggtagtccaaattcattctttgcttgtgacatccatttgtccctgcaccatttgttgaacagacttttgtttccccattgaatggtcttgtcatccttgtcaaaaattaactgaccataaatgtatgagtttatttttggactctcaattctattccactgatctatatactatccttattccaggaccacacgattttgattactgcagctttgtagtaggttttgaaattgggaagtgtcagttctccaactctgtttttctttttcaagattgttttgactattctgggtttcctgcatttctttctttctttcttttttttttttttttgagacggggtctcactctgtcacccaggttggagtgcagtggtgtgatctttgctcactacaacctctgcctctcgggttcaagccatcctcccatctcagcctcctgtgtagctgggactacaggctcaggcttgcaccaccatgcctggctagtttttgtatttttaatagagacagggtttcaccatgttacccaggctggtctcaaattcctgggctcaagtgatccgcccacctcggcttcccaaagtgctgggattagaggtatgagtcaccacacccggctccctgtatttctgtgtgaattttaggatcagtttctcagtttctacaaagaagccagctgaaattatgctagacataacattgaatctacagatcaatctgtagattgccattttatcaatatttggccctctaaaccaggatgatcaaatgtctttcatttatttatatctttaatttccctccacaatgttttgcaatttttagtgtaagctttacacttcatttgttaaatttattcataagtatttttgatgttattgtaaatggaattgtttccttaatttcatttccagattgttcattgctagtgtatagaaatacaattaaattttgtataacaatcttgtattttacaatcttgttgaactcatctattagttctcatagtttttcaatggtgtccttagaattttccatgtacaaaatgatgtcatcgttcaattcccacctatgagtgagaacatgcggtgtctggttttttgtccttgcgatagtttgctgagaatgatggtttccagcttcatgtaaatgacgagttaatgggtgcagcacagcaacatggcacatgtatacatatgtaacaaacctgcatgttgtgcacatgtaccctagaacttaaagtataataaaaaatgatgtcatctatgaatacagatggttttatttcttcctttccaatctggatgtcgtttatttcttttttatcttgtctaatttcccaggctagaacccctaatacaatgttaaatggaagtggcaagagaggacattcttgacatgttataacattgctttctatttcactaatttctatttatcatattatcgtttttaaattttattgggcttattttgtttgttttcttacatcttgagatggacaattcattaactcattaactcgtggattttcatcattgcttacagatacaagggtgggtttttttgttttgttttgttttgttttagagacagggtctggctatgttgcccaggttcatgtgatcttcctgtctcagcctcctgagtagcagggactacaggtatgcagcactgtaccgagctcccacaatttttgatatgagtatttccattattgttcagcaaaaaatatttttaatttcactatcattgttctttgactcatcagttattttagagtatgtgtcttggtttccaaacatactgacattttccagttatctttttattattggtttgtaacttacttgcattgcaatcagattttaattctttgaaatttgttgaggcctgctttctggcctaacatatggtcaaattttttttttttttttgagacagagtcttgctctgtcgcccaggctggagtgcagtggcatgatctcggctcactgcaagctccacctcccaggttcacgccattctcctgcctcagccttccgagtagctgggactacaggtgaccgccaccacgcctggctaaatttttgtatttttagtagagatggggtttcaccgtgttagctaggatggtcttgatctcctgacctcatgatccgcccgcctcggcctcccaaagtgggtcaaattttataagggtgttgtatgtgtattctgtagttgttggctgtggtgtggtgttctatatattggctattagttcattattaataacattgttcaaaaattctatatccttagaggcattttttgtctccttgatcaactactgagagaggtgtggtaacactttccattctaattttatatttgcttatttctcctttagtaaattaattttcctttatatatttcaaggctttgttatcagcataatcattcaaatttgctaaacttcccggtgagttggaacttttatcataataaaataaccttctatatctctcgtaatgctttttgcttttaagtatattttgcctgctatgaatatagctatacaagttttctatctgttatatattatttgcatgatttttctgtctccatgtttttactatcaacctatgtgtacccttatattttggatttgtctcttttaaacagcatgtagttgtgtttattaatcccatttgacattattttttaacttgagcctttagcttttaaaatcttttatgttttgtaattttaaaaatccttttattgatacatactatttatacatatttatgggatacatgtgaccttttgatacatgaatacaatatttaatgatccagggtaattaggatacctatcaccttgaacatttgtcatttctttgtgttgggaacatttcaaatcttctcctctagctattttgaaatatacaacatattgtttttaactatggccaccctattgtgctattgaacactataacatattattttaatgtaagtcattaactaatctctcttcaaccctccccacaacacacacccttcccagcctctggtaacaatcattctactctctaactccgtgagatacacttttttagcccccacagatgagtgagaacgtgcaatttttatctttctgtgcctggcttatttcagttaacgtaatgacttccagttccatacatgttgctgcaaatgataggattttattcttttttatggctgaatagtattccattgtgtatatatactccattttctttatccattcatccattgatggacatttaggttgattccatatcttggctattgtgaatagtgctataataaacctgggggtgcaggtattcattcaatacactaatttcatttcctttggctatatatcatatgatttctggatggtatgatagctctattttttgttttctgaggaacctccaaactgctctccatagtggctgtactaatttacattctcagcaacagtgtataagagttttcttttctctgcatcctggccagaatttttaatttttatcttttgataatagccatgctaactggggtcactgtggtttagatttgcatttccctgatgattagttgagcatttttttcatatatttcttggccatttgtatgtctttgagaaatgtctattcagatcctttgcccacttttaaatgggattacttggggtttttgatgttgtggatcataaacatttaataaaattattcatatatttgggtttaaagcttaattttattttgtgcttttatttgtcccatttatatttctttcttgatttaaaaaaaattgaaaattttgtgttgattattcaactttttcccctccctactattgatagcttggaaatttacatcctgttactattattttaatagtcacatactattaattactagatatataattaccttatcagaatataaatttaataaatacctaaataacttccaatacgataccaggcccttagaaaagttgaaatccatttaagcccctcctgacgttttttctgattgtatgatacattaagtttattttttaaaaagaagaatagatgtttttctgatttcttcttctgccaatgttctcttacattgcccacgtactaccacttcctttgctcttcattccttcctgtatttatttcttttaaggtcatgttcctcctgaagtacatacttcagaatttccattagcttggtttgctggttacaaactctctgttttgtttgtctaaaaataactattttatcctctttttgaaaacttttttgagtgatgctgcccttagaatgccaggttaatatgtgcagcatctcccataagcacccccatccagtctttgatatccctgagccgaagcccgagtttgaagtgaccatatgctctcagaaaccttggtgaaataacaatgcctatctgaataggtttgatgagacacttacatgagataaggatggaaaattcctggcacagaggttgaaggcaactaaagggagttattctttcaactgaaggcattggctctgaatcttaaggattttaagggttttttgtgtgtgtgtttttgttttgttttgttttgcaattggaaaatgaaatgtggcctccttagaaccaccagagctagaattcttgtaattggaagcccccttacccccaacccctctcctataatatgaggccagagataaggtatgctctgtatccaactggagccagtttagcaaatgctcctccaagccctatatgaagagacctccgcttggttctgatgatgcaacccaggcaactttacacaatcaaaattttttgcacagctctgagacacagtctttgtcctttctgatgccaccaggtccaactgcagaacacctgatttggcgatgaagccaatttaaatgtagaacacgattctgcttagaggccagggtcagatgtcatagtattggggagcagaagcaagagtctgaagaaaacccctaagctattgccagcatcacccccgactgtgtgaagtaagcaacctgccttctctgcacctccaaaatcctccacccaccaccaccaccattccagtgttccatccacaagagaaaggtcatgcccctgagatgaaggtgctttgtctttaaatgtagattgtttactccaaggaattctaggtattggagttggaaataagaaggcagaaagaagcaggtaaagtaccttggcaggctgaagctgaaattaacagcagctgaaaagcatcagactgttcactcacttccaaacatcaggagtcaagaacaagcaactcctttgcacttgggcagtccaagtgcacttggtcttgaccccccaaagttcccacaggagtctcttaaccacactttacatgagagaaggaaggcttgctttcccagaaccagaagtaagggaaaatggagtgctgcaggctgaattatgttcccccaaattcattgtaatcctaaccctcagtaccttagagtgtgactgtatttaaagatagggcctttaaagaggttattaaggtaaaaatgaggcccttagggtgggccccaatctgacttgtgtccttataagaagaggaaatttggacacactgagagaacccagaggcacatatgcacagagaggatggccaagcaagagggcagccatgtgcaagccaaggagagaagcctcaggagaaaccaaccttgctggcaccttgaagttggacttcccaaccttcagaactatgagcaatacatttctgttgtttataaaccacccagtctatggtattttgccatagcaccccaaacagactaaaacagcactgtaacaaattatcacaaacttggcttaaaacaagagaagtttaatttctcacagttctagaagccagaagcttaacatctgtttctctgggctgaattcaaggtgtcagtaggactgtgctttattccttgcctcttccagtttctggtggctgctagcattcctctgcttatggccacatcactaatctctggtcattgccttctcttcttggtgcaccaactctccctcttttataagggcacttgtggtttagatttcagcctgcctggaaaattaagtcaaaaagccttaacttaatcacacctgcaaagaccattttactttataaggtaacatttacaggtttcagggattaggacttgatacatttgggtggccattatttagcttcatacagagtccgaaatctttgcatacaatttcaggaagatcatggattccaggtaggcacatctgctctggagttgcatttcaccacagatacctgtggacagatattggagacaggctcatttacttattcacaaaccttgctacaactcagaaccaaccgcagcgccggttaaaaatactaaatacaaaaccacatcacaaccgctagtcctagtaaatctgaatccaccagagttggggcccagagcctacatttcttttcttttcctttttttttttttttttttttttttttttttttttttgagagggagtcttgttcccttgccaggctgaagtgcagcggtgcgatcttggttcactgcaacctccgcctcccaggttggagagattctctagcctcagcctcccaagtagctgggattacaggcacgcgccatcatgcccagctgatttttttttttttttttgtctttttagtagagacggggtttcaacatgttggccaggatggtctcgatctcttgacctcgtgagccgcccgcctcggcctcccaaagtgctgggatttcaggcgtgagccaccattcccggccagaagactgcatttctaacaagctcccccaaatgactctgatgtcttgcccccatacttgaatgggtattggttgagagccttgttctccagctctcctctctgttaaatggacatactgctacttctttcacagtaaaagaggagatgtgtgtgaaagcctgtttccgcaatgcacgtgctaatgctcttcccgccccttcccctcttccccgtcttttccctataccaaggtgaagaacttttattattcacttgattttggacccacttcgtgtttaatgcacctggcctaagatgcagagttgagcccagggagaagggacgggttgggggaggaagaaagagtcgcaaattcccaggcagattggctccatcggtctaatcaagctgcacttgacgctccgcgggcctgctgcgcccccgccccctcaggcgaaaactcgcctctgcccaaggctgtgcggggcgtccgcccccgcacttcgctgattggccgcactagcccgctcgtcacgctcttttgtctcagctggcagaggataaaagccgccgcggctgccttaggaacggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggtaaagaatgggggtgtgattgcccggcggggagaggggtgggggaagacccaccagtactgggcggctcccagcttggagaatcggtgactgtgaggcaggggtaggagtactctcgtggcccggctgcgctgagggaggaggtggggttcacctggatactgcgggctaggtaggatttgcctggatttgggggtgggaggagaggcgaggagtagcggggggaggaatctcgagctgtttgcttcgaacatcctttgcatctcctcatctctttctgggaggaatatgtgggtgggtgtgtccaactcctattccctttctccgtggcaggccatcaaagccgcatctgaacttgaattctgtgcagctgattgcagagctggtaggccgacggcttcccgggggaaatgtaatgctggagggtggggggctggtctctggcttatagtcaggagggggcagagagaatttttcgcctggcaacagcggaggtggtgggtagcaggatgacgggtgaagctgcttctaacccttcccttctctggccttctccgctgtggcgcaatcttgaaacctcaaggacccggatctgcgaccccctgtggacagaggttgaccgtaccccggagaggagctttctcacggagggcactggttgcagaggctggaagtgaaataaagacgcgctcttgtttcagagttcgtgtaagaatctgagaaataacaagggggacgggcgtggggggcactttgagaagggggtgtggttgagaccagagaccatgaggttaatgagatcttattttatttccacaaatctgcgatcattgtactctatttggagagcccaatatcagctccagacactgctacacctagaatttgaagcaacagttaccgtccctcttggaggactggtgggagggatggatgtggctgcaaaaagcaccttgctagcacgcaggcatcgggtagctctgggaggttgtaagtgtcaatctcctacaggattatttttagggtagtgggcaaatataaaatgtactgcaggatattcaggtaggaagagaatgcagctgcagcccgctcccttattaaccagcccccctttcttttttacagcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaaaaataaatgggctgagatacttcccaaaggtaaaaggacagagcccccttaccacaactaacctgtcccttcgctcagagagccaaattgtgacacccacttgttgacaaaacaccagtgctttcttctctgatatacccaggagactgatgggggatgggggagtccggtgctgaggtaatagcccaatatggggattccaggggctccatttctgttcactttggggatgggcagttcttcatctgggcagattccttagattgttgttgctgttgctgcctctggacaacgtcctggtcacaacaaggaatctctcctgtgggctgacaccaccttctgccccctccccagttaaggaaaagagagagcagccactcatgggagctcagcattagcaggctcaactcctgacggcgccagagcctcccctataaactctgaagctatgcgctggaggccaccggcagcccacggactccaagttagcttgggagacacgaaaagcaatatatttgctggagcacgtgaaggaacatgggaatcggaaagccaggaagccctgcactctatgtgagcagagccaagggcatccataggagagggagagaaaagagggaccacctcctcatctcatcctggagggcgatagaagaggactcgcgtgtgacctcaggccccaaaggtccctatgtttcttgtaggtgcctaggtccctatttttgcgagcaggacaaggctggggaatggggtggaggtggttgcacttaaggcagaggtcgagtgtgaaatgaatatgcagatttgggaccctcagggagtctgccctgccggaaataggggctccacggagctgagaggatagagtatgaagcagtgagtgctggtgtgtcgaggagaagcacagggctcgatgggcgggagagaggagagagtgctgtgaccagtcaattcacaacttcattgactgggacagggagcctcggagatatcatagaccctagggtttcaaactcgtctctgggctgtgttgtaccagaaatggctccggttgaaggtcccatggaggggtattggggttctgattatgttggcagttgatggtccactccgtggggacaaagggggttcagtctgaggccccaaggaaggagtggtagccaggcactacaagaagtgttccctgggctgccatgccaagaatctggcgtgaagtgcttctctttctagaaacaggctctcagctactccctggcttattgcccctgctccactcatgaccccaccatttgaccttataaccaccagcccactgccctcctggagccacgtacagctgctggtggagggtgtggagctcagtctcctgggctctgcccagtctcccttccctcctccccacagcattcaacatttaccttaagcctcagcctcctttaccctcctggccaaaaggagactgggagggcccttctgcctctaactctttttatttgagacagagtcttgctctgtctcccaggctggagtgctgtggcacgatatcggctcatcacaacctccacctcccaggttcaagcgattcttctgcctcagcctcccaactagctggtattataggcaaacgccattgtgcctggctaatttttgtagttttagtagagacggggtttcaccgtgttggccaggctggtcttgaactcctaacctcaggtgatccacccgcctcagcctcccaaagagttgggattacaggtgtgagccaccgtgccaggcctcagcttctgaccttttagcttaagaaaaactgggtcaggagcaaagactcaagagggccactccttgcatccttctggggcatctctgggcccctggcagcaatctcagtctctccagagccaagagggaccacttgtgcacccccagacaggtggcagctccactcaggcccccaaagccaaagaggcccccaacattctccagcttgcatagagtttaacccttaattcctccctaaatctactcctgggtgatatctacccttctcatctagtacagattcgaatattgttccatttcctgttcacgttttttggttttactctataaacacttgttgagtgatttgtccaaagacacagattatgctgctatttctttctattaccagggggagtagaaaaatgaataaatcctatccataccactacttccctttcactggagtgagcttggatgttcagtatagaccactgctttcactgctttgaaaacctattttgtgactcattccctttcatcctcgccccctcccctttttttttaaactctgacactggcttttagtttattcaagaaatatgcattcttcctaattggatacctgggcattcagatcagatgaatagagttacctaaaaggcttttagagaattttgtgtcggatagccttcatttaaagatatgggcttattttcttcctttctgccttcattctcattggtcgctaagagatgagaaattgctatttcatcttgtcagaagaaaccagtctctgagtgcccttttacacaatctccccgcttcctggcatcttgtccctccgtttccatgacatcccccctcacagttcccgcttcctgaccttttgatgcccacttctcggtctcctttgctgaatcttcttcttcttcttcctgatccttccataataatgatacaataaacatcattaaaatttttattttttttgagacacagtctcgctctgttgcccacgctggagtgcagtggtgcaatcacagctcactgcagccttgaccttcccggctcaagcaattctcccatctcccaaataactgggaccacaggtgcatgctaccatgcccggctaattttttaattttcagtagagacagggttttgccatgtttcccaagctagaaaattgctatttttaagagcttattgtgtgccaaacatcctgtatcaggctctttgaaggcgttggttccttgaatcctcatcttaaccccatatggtattgccatttttacatattttagatgaggaaataaactggaacattaagcagctcacctagggtcgggcagctagttagtggtagagccaaaggtcacattcctggggactggctccaaagcatataattctttttttttcttttctttttctttttctttctttctttttttttttttttttgagatggggtctcactctgtcgctcaggctggagtgcaatggtgcaatctcggctcactgcaagctccgactcctgggttcacaccattctcctgcctcagcctcccgagcagctgggactacaggcacccgccaccatgcctggctaattttat[195 bp omitted]taggtgttattatctgcatgtgacacgaaacaaaattgaggtttgtaaaaattcaggataataaggcctgcctttccaggtgtgccctttatatgagtgattaacatagggttggtccattgtagactcccacagactctcaagaaatggcagctactggacatctgctgaaatgcattactctgctactgaaggaagggcaggaaaagttaaatgctgtccatgccatgcatacagtgcttattcagtgttaatctgatgatatgacagtctggtttcaggagctacactgagcttggcccctgacaggagtcctttacaattcaggtgaccctgaaatcctgccactgccagagttctcaggggcaggataaaaggaggcagcgagactagctctgggtcttgagttatcatcctggcaggaaatatgtatggatccttagctgcagcagctcattgcagaccagagctgacaacttaggttggcctcacacacattcttcttccagatatgtaacatgttcatcatctccattttacagactaggacattgaggcacacatagttattgtcacttgcctaagattacacagatagtaagggttggggctggaattgaacttcagatctgcctctccccagagccagaagtctttacagttatactataaagtccttcctaatgggtacaatatatctgatcattctatcggttgcatcctgggaaccaatttctaattgccatactcacgaccaaaagcctgcacagtaacatagccttggtctcatttcttttattaaacaagacggaaaaaaaaagatcagtttaggaaagctccttcttagagcctgtaactatcttctcttcatatttatttttatatacaatttctgggataagatactaaaaataacaaactgttgatgaggatgtggacaagcagtctctctcccacactgctggtaggactgaggattgaggcattcttgctggaaggctgaccaggaaatgcatcaaaggttgaaatataaaaatccctggatccaacagctgctgaaattgatgctgagaacatagctggacaagtgtaaaaaatttttatgaacaaagatgtttaccctagtttattttgtgtaatagtggaaaactggaaacaagttaaaagaccataagtaaaacttgggtgaataaattaggcttcatacttgcaagacaacgctctgcatttcaagctctcggtgtgccttcagatcattgagtctaattggaaaaattaaatgtggccgctctaaaaacgggcttaaaaccccaggccatctgtgttctctctgacccccagtgtgctgctccatcagtctggaactcttttcacctggcaaaacccttgtcaaacttcaagtatcctctcatctggcactccctcgggccagcttgccctgaccctgctaaagctcattccccgaatcttaggtagcatttatcattgtgttgtaattgcttgtataactagctgtcttccccactaggcttttatcctcccaagcctagtacaatgttgttggggcatcttgacacagacttcaggcacgttcccacctcaccagtttgcactggttgttctcattgttcctccaaatagccctgtgccttaatcattccccatgttcctgtatttgctcaaatgccatcttctcattgaagctgaccctgaacatcccatttaaaacagcacatctgatcatcagcactccgattctctcttgcctgctctatttttccatcacatgcctttcttctagtatactacataatttactgagttatattgtacattgatgtctctccccaccagactcaacgacagcaggcattctagttaactgcagcatcaccagctcctggaacactccctggaacagagctcattctcagtaaatatttgtggctggaatgaacaaagtgcctggcacacagtaggccctcagtgaatgccagcttttgttactgcctcctacctggaacaagtgctgccagaaaggagacagtcaatgagagaatagtgcacattgctgagccaccacccacctagccgatgaaatcacaaacctggaagacattctatatccattgcttggttttcacttccccagggtatcacttattagatggaccattcactcctagcatggcagaaagtgggaaatgggtttctttgtagcttcatctatgtcacatt[179 bp omitted]gtggcgggcaactgtagtcctagctacgcaggaggccaaggcaggagaatggcatgaacctgggaggcagagcttgcagtgagacgaaattgcgccactgtactccagcctgggcgacagagtgagactccgtctcattaaaaaaaaaaaaaaaaaaaaaaaaaaagagtttcaaatccctaatcatcccaagtgcatttgttttgtaatcccatgggcatttgcaagatgccccaacaacattgtgctagtcataggggatataagcctgataataactcataggtcctgaagctaaactgcccagatctgaagcccagtctcagcatttactagttgtgatcccagtcaaggtatttaccctctctgtgcttcagttgcctctctctaaaatggggacaataacagtacctatcttagagagtagttgtaagaaataagcaagttactatatgtgaaacacatattacaatgtctggaaacaggcaagagctctataaatgttaactatcataagccattagtatttaacaaatatgaatgcctataggcacgagtttgaggaatgaaaaagagggaagtggagacattaaatttatatttttctttacccaactcatgaaatatggggagatcagagacaggttaatatagctaaagagaaccgcggggtcaattcaagcattacacttcctttatcaacccccatttcctggaaagttgcccagtccttccttttctgctccta[136 bp omitted]catggtgaaacctgtctctactaaaaatacaaaaaattagctgggcgtggtggtgggtgcctgtaactccagctacttgggaggctgaggcaggagaattgcttgaacccaggaggtggaggttgcagtgagctgagatcgtgccattgagcttcagcctgggcaacaagagcgaaactccgtctcaaaaaaaaaaaaaacaaaaaacaaaaacctgtcacaaacatgtttgttttgttatttactcatgtgtttaatatccacaacattcgtgttttacatgtcttttctctatcctagaatccaggctctttgagtgctggggctgtgtcttatttgtctttataaaaggatttctttgttagtgctttatttttagaatatgttcacatgcttagagtaaggaaaaccactaaagagagaaagacaaggaattggctaaattccttaaaaatatgaaactacccaggtttggggatagtaactgaccaggagggcttttttttttttttgagacagtgtctcgctctggagcccaggatggagtgcagtggcacgcaatcatggctcactgcagcctcgacttcccaggctcaggtgattctcccacctttgcctcctgagtagctgggaccacgggcatgtgccaccacacccaactaatctttgtatttttggggtagagacagggttttaccatgttgccctggctggtctcaaactcctggactcaagcgacctgtccacctcggcctcccaaagtgctgggattaaaagtgtgagccactgcacccggcccattttatcatttgactggggctttgggaaagtatgaagaggttaagaagggaagttaaggaaaaccatagctagtagtcccaacttcctctataaattttaacacaagacatctccgagagactatgcttaattgggggagtagaatttgttgaagtctccttgcatgtgcctaacttcaattccttttcatgaacattttcaccatctgttgcaatttccctgcagtttactattctctttcaaaaagcagtactatacagagtattccagatgtcatcagatccatatagtgggactaccaccttcttcaatcgaacattggtcaaatggaaataatagtctcgatcacatagtgttgtaaaaattaaatgaaaaatttaaaaaagaaaataactgtcttgaaaaatatgggtatattgggtactctttgctattttccttctattaaggaacaaacaagagtgataataggaccgggcatgcttgctcaggcctgtaatcccagcagtttgggaggccaaggcacacagatcacttgaggtcaggagtttgagaccagtctggccaacatggtgaaaccctgtctctactaaaaaaaaaaaaaaaaaaaaaaaaaaattagtacgactgtaatcctagctacttgggaggctgaggcaggagaatcatttgaacctgggaggcagaggttgcagtgagctgagatcgtgccactgcactccagcctgagtgacagcctaagaccccgtctcaataaaaaaaagataataataaatgattttcaatcactatgtattgaacatgtcaataatatagtaagaattcttaatcccatttaagagaatatcaatgagtctcagcaaaagatagtaacaggactaaggtcatacagtcagtaagtgaatggtaagttgggcggctccaaagcctgtgaactttccatcacatattttaagtaaaaatattgacattgcttagaaaaactgtatcataatggaagattagttcttggggcaggagaaataagcagatatgaatatttgaccaatttcctattcatcaagacaaagctgtttgaaaaactataagtaaaggaacttaaattttactagttggaacatgatagaggttttttttttttttctttttttttgagatggagtcttgctctgtcacccaggctggagtgcagtggagcgatctgggctcactgcaagctctgccttccgggttcacgccattctcctgccttagcctccagagtagctgggactacaggcacctaccacgacgcctggctaattttttgtatctttagtagggacggggtttcaccgtgttagcc[131 bp omitted]ttggctcaggaaaatataatttaaggtagaatcttggggctggttatggtggttcatgcctataatcccagcactttgggaggctgaggcagaaggattgcttgagcccaggagttcaaggccagcctgtgaaatatagtgagacacatctctacaaaaaacttaaaaattagcccggcatggcgatgtatgcctgtgatctcagctacttgtaagggctgaagcgggagaatagcttgagcccaggaggtcaaggctacagtgagccgtgatcatgccactgcactttggtttgggcaacagagtgggaccctgtctcaaaaaaaaaaaaaaagattcttggccaagtgcagtggcttatgattgtaatctcaacactttgggaggtccaggcaggagaattacatgaggccaggagttcgaggttgcagtgaattgtgatggtgtctgagcctgggcaatgagactgtctctaaaaacaaaacaaaacaaaacaaaaaaacaaaaaacagaaaagaaatgtaaattttttccttctctgtgtgccagaatgtttgtaaaactatttcatttattaaattattttaggtttgttacaaaagttgaatatttagagtgtcacaaaattatgtaaaatacagttaatacttaaataatcataaaagtatacagtaaaagaaaaaataaatcataggtaaacactgaatattttgggatatttcttttatttcttttttattttttgaagacagggtctggctctgtcacccaggctggagtgtagtggcaccgtctcagctcactgcaacctctgcctcctgagctcaagccatcctcacaactcagcctcccaagtagctgggactttaggcgtgtgccaccacacctggttaatttttgcatttttagtagagatggggtcttaccatgttgcccaggctgatcttaaactcctggactcaagagatcctcccaccttggcctcccaaggtgctgagattagaggtgtgagccaccatgcccaacctggcatatttcttttaaatcttttttctaaccctgtgaatgtagatacatgtataatttactttattgggattgtactctctaaaaagggagttttacatatgaagtatttataaaattgtttttgttctttttctaatgacaaatgtgataattttgagagcaaaattaaagattatttgtcaaaaaagaggagtaaaggggtaaagcctgagcaaatataaaaacatactaataaaaaaactataataaacactgtgttgttactggctgacaaatatccatcataaattgtaataaatatgactcttttcctagaaaaagcaagagaattgatggaaacacagctgaaaataaaacaatgagggacaataacataaaactgaatgacttaggagaagaaaatgatactactcttttgagtgcacctgttagaagatttgaatgaatggagaaaactcaagcttagctggagggtggtaggcctggtggctggggtaaagaggaagatatcaccataaaatcatccaggccccagccacatcataggccaacctcaccattacaatgcagggaccccctgctccaataggcttgccagtatgtga[144 bp omitted]tctactaaaaaatacaaaaagtagccgggtgtggcacgtgtctgtaatcccaggtactcaggaggctgaggcaggagaatcacttgaacatgggaggcggaggttgcagttagccaagatcatgccgctgcactccagcctgggtgacagcgagactccatttcaaaaaaaagaaaaatcgtgcaaatgcttggctaattattccaacaccattaattgaataagtgggaggatcacttgaggccagtagttggagagcaacctgggcaacatagcaagaccccatctttaaaacaataaaaaatcaaatgctcgctccccatatatcaccaatgcacctgatgatatgacgaagtgcatttattgcttccctcactacgggagaacaccacttcgtgaagctttagcggtgcttcagacaggaaaagaaagatcagaatttattgagaaatgaaaaatgggcttaaggcggtgagtctttcaatgctgggatttgattgggattgggtaagaaccacgagataccaacattctaggattggtgtaagcagcaagaggaggattttaatgagaggcattcaaaaaattttagagtgcaaactgttggtgctgtccattgacgagttgatgggcctttgcagaagatcctgtaatgcagaaactattcgcctgcagagaacgtcctggaaaagtaatgcgaatgaagacagtggattagcaaagtcctttttatgtagatgctacagtggggtttttgattctcagtgtccaggccgagtttggggatagatggttttaattcccatatacatacatttttaatggacaattcaccttaggcacgtgtttattttatggtgtcaaaatcctttcatttctcgaaggtgtttactgagacctgagttagttgctaaactagctggtttaaagctaaacaagtagcttaaacctgtctgctaaaaccttcaggtggattatttcatttgctcctcacaaacacctgtgaatcctcacaaacacttcaccattattgtccctattttatagaagaggagaatgagactcagaagtaataattagctcacaatctcggggctacaaatacatgttttcaggagcatcagcaaaaccctcttaatcaaacaaacaaacataaactccaaaaccctgccttattcttctgtttttgcacaaggagctggaatccaggttcaagataattatctggccattctgtcttcttagaggtccttttccctttcgggggaagggaggaaagggtggaagcggcttccacccactccagttcgggcttgggtcagctccctgggcttcgcggagcacgccctggtgccaccggcggggccatttccgccgcgggggcccagacagcgccgccggctcgcgtagggtccagcggaccggcaggctcgccctcgcggtgccagctctgctctcttctggtcaccagggggcgccagaagcaatggtgcatcccgaaagggacggcggccacgtgacaggggggtcacgcgcagggtcgtaggggaccgcctggggatccccggacggctgcgaggaatgagcggttggctcgggctggtttcctccctccaccgcctgcttgtttcgccatgcccgggccggacggtggggctgcagcggcgaaagcgactgaagtccgggagcagtcgcatgagcttcccggtcaccaggaggccccgggaacagacacctcaccctgacattgtggcaggtttggcccttcccgcaatgcaacaaaggagggactttgtcccagcctttcccctagccaggagaggtgctgttaaatccctttgtgcctccccaccggccttggagagatgagatttcccctgtagtaccccaggggacgggccgacgggatggactttgtatcttttggctgatctggccggacatccttgcccaataagcacttacccagttgcccaccctccaaaaaaaggagaaaatcaaatcagtaatttgatcgatcattttcatagatatgctgtaatagaacaattcacctggttgtgaactgggctggggagtttcaagacgtgagtttgttaactgactagtttcttgcttggtgtagaggccttaggcactctcacacttaaaccagcagaaaggccagggagtatctagactacacactggggtcactcaactggaaacacgttgtacacctcaagacatcgtacaatttctcagactgagatgctggctgtgatgtctatgcagcacagccccaagtcccaactgacagaaatgtctcagaaacttaattcaccacggtctttttttttttttttttgagacagagtcttgctctgtcgcccaggctggagtgcaatggcgcgatctcggctcactgcaacctctgtctcctgggttcaagcaattctcccgcctcagcctcctgagtagctgggattacaggcgcccgccacgacacccggctagtttttgtattttttagtagatatggggtttcaccatgttcgccaggctagtcttgaactcctgacctcaagtaatccgcccatcttggcctctcaaagtgctgggattacaggcgtgagccacatgcctggcctcaccacggttttatttttgtttttgtttttttttgtttttgtttttgttttttcttgagacggtctcactctgtcgcccaggctggagtgcagtggcacgatctcggctcactgcaacctctgcctcctgggttcaatcagttctcctgtctcc[217 bp omitted]ggaaaaacagttaatttataaagaaactgaataatgtaataaattgaggaattttttcccagccttgtactttttataccatcaaatccactgactttaagtgtacagtttaaaaaataaatttagccaggagcggtagtgcacacctgtagtcccagctacttgggggctgaggtgggaggatcacttgagccagggaggttgaggctgcagtgagctgtgattgtgccactgcactccagtctgggtgacagagcaagaccctgtctcaaaactaaacaaataaataaaaataaatttatggagttgtgcaaccatcaccacaatacagttttaggacattttccctatcccccacgaattcccagaagcagtttgcagttaatctcctctctcatgtttagccctaggcaaccatttgtctgctttctgtctgtatatagttgctttttctggacatttcacatgaatggactcatacaatatgtggccttttgtgtctgggttctttcacttaacatgatgttttcaaggttcatccattttgtaacattatcaatactcccttcctttttctggctaaataatattacattgatggatataccatattttgtttttccactcatcagttgataaacatttgagttgtttccactttttggttgttatgaataattctgtgaatattcgtatacaagtttttgtgtggacatgttttgggttctcttgggtatatacctaggagtggaattgctgggttttataaagtaactgtatgtttaactttttaggaacttctggattgctttccaaagtggctgcactgttttctatccccactggtaaatgtatgaggatttctatttctccacatccttaccaatactttcttgtctgtctttttgattagtgtctcattgtgatgttaatttgcctagattgagtgacttttggttgtatttggtttagctagtttcacttcatttaatgaatgccttttttagtgttataaaaattaggagctgaaatgaataatacatagtccttccttgcaaggagctcatagttccttcaggaagacagacaacaaaacaatgacagtatagcttgttaagtgctctgaagggagttgaggacaagatgctctggggagcagagaagaggaacacttaaccctgcttgaaggcgggtggaggaaagtattaaggaaaccttttacagaagaggaacacttaaccctgcttgaaggcgggtggaggaaagtattaaggaaaccttttccagaagaggacttaatgtgcctctcgttttcttttgtttattttaatcaaaattatacaagtacatactgtaggttttttatttgttttgaaacagcatctcgctctgtcacccaggttggagtacagtggcgcgtgcaatcacagctcactgcagcctcaaccttcaagcaatcttctcacctcagcctcccaaatacctgggactacaggtgcacaccaccatggc[136 bp omitted]catggcgaaacctcatctctactaaaaatacaaaaattagctgggcgtggtggcatgcacctgtaatcccagctactcaggaggctgaggcaggagaatcgtttgaacccaggaggtggaggttgcaatgagctgagatcgcatcactgcattccagcctgggtgacagagcaagactccatctcaaaaaaaaaaaaaaaaaaagaaaaagacaaaaaaaagacagggttttgccatgttgcccaggctgatcttgaactcctaggctcaagcgatcctcccatctcagcctcccaaagtgctaggattacaggtatcatactgtagtttttaaaaatcaaatagttctacaagatttgctttttttaaaaaatgaatcatttgctttccttcccattccatgttgcccccaaaagcaaccactttctattcttttaagtctttgaatatttacctgtatatctttaaagagcatatttatatttgagaaaaagaagccccaacataggccaattaatatcctcacttgcactgatttttaaattggtcagccctattaaatattaacacatagttagttatgaaagtgacggtcacaatgcagcctaccttctgtccatctaaatgaaagaagacaggcatgctcaacagttagctactagaataac[136 bp omitted]gcgaaacaccatctctactaaaaatacaaaaagtagccaggcgtgtgcctgtagtcccagctacttgggaggctgaggcaggagaatcgcttgaacctgggaggtggaggttgcagtgagctgagatcacaccactgcactccagcctgggcgacaaaaaaaaaaaaaaaaaagtggctgaggaattgtttttctcattggtgctttactatcatatagctccaataagccagcacccaaatgtaactgtcaattatgaggaatgttattttcacttaaactttaaaagaaaagcaaaccacaaacaagctgcatgatgtagtataggaattagcaatctatgacctgtgagctaagaatgtgttttcagatgaatagtgacaacaaatttgatgatagggaacactaattttcaaccctaatgaagcaaaatattatttttctattctaaccttttcattagtagaactgtattataaaaccttatagtcaattgttattactttttaaatttcattaattaaaaatttgtacaattttgttttctctcattatgtaaatacttatataatatcctcgatcttgcttcttggttcataaattctaaattattaattctctgaccttcacagaaaagcttgctaactcctggtttaatagaataaaaagggctgggcgcggtgactcacgcctgtaatcctagcactttgggaggctgaggtgggcggatcacgaggtcaagagattgagaccatcctggccaacatggtgatcaaaagatcgagaccatcctggccaacatggtgaaaccccgtctctgctaaaaatacaaaaattagctgggcatggtggcgtgcacctgtagtcccagctacttaggagactgaggcaggagaattgcttgaacccgggaggcagaggttgcagtgagctgagattgtaccactcgcagtgagctgagattgtaccactctaccccagcctggcaacagaacgagactccatctcaaaaaaaaaaaaaaaaaaaaaaaggtatggaaagcaattgacatgtacttgctgtgtgaccttgggaagtcactttatgtctctggtctttatttttattatctataaaatggagctaaagggtaatgggttgatgagataaactctaccatgaatcccccagtttttgattaattaattatacaagtatttattgagttactgttatgtaccaagaactgttaaatgcattgggaatacagcatgaaacaaaatttttgtcctgaaagaagacactgttctcaatgaaaagagacttaagatgcagtgtgtggtctgagattggatcatgatttaaacaaacttgcttaatgggacatttttgggaaaattagggaaatttgtatatggatggttattagatgatgtgaaaactttttaagatgaaatggtggaggtcattaactgaaaagggcagttgtaaaacattttgtacagtatttcatttttggaagaaaatgcgtatatgtattacatatacttagaaaaaatatctgaaaagatatatactaagctgttaatggtgatttctgtgtgatgggaacacaatgttctatttagttatttttgctttcaaatttttcacaatgaatatacactgcttttgtaaaaataaaagattgtttctaatttaaaaaataatctctcttttcacaaagcttatagctaatgcctcttgtaagtattcatattgccaatttgtcacttttttttttttcagggcaggaaaacatctaagaaaggaggctccccccttcccttgcaggtaacaaagtatcggggtgatctctgtgaaatagctactgaatgtaaactgatgctactggcattcctctgggacttttactgataagtagagctttcatagtcttcccaatttcagatgactcgagattgaatttctttttctttccttccttccttccttccttccttccttccttcct[137 bp omitted]tgcctcagcctcccgagtagctaggattataggcacccaccatcgtgcctggataatttttgtatttttagtagagatgaggtttcaccatgttggccaggctggtcttgaactcctgacctcaggtgatctgcccgccttggcctcccaaagtgttgggattacaggcatgagccactgcacctggtctagattggatttcttatcttgcaaagccaaggtgaagtccagaccatgaaaaagcagaaaatgtatcaagataaatactaccttgtgagccctatcaatagtcctaccaatagctttctgatattggaggctttcaaatgagattttttttttttagggttaccagcaattaaaaagaagtactagagaggcaaatatcggcagtatacatctaagcgctggtcggaaaagaaggaactcagcccaagaacttgcccaatctgatactggaggtaggtgtatctctgttgcatccatgaacgcatcaggctaccaaagcccgatgtgattaagcatttgaatcgtgtaactgcttctcttattgtaggccaggagtcagcaaacttcagcatgtggaccaaatctggtctgccatctatttttgtaaataaagttttattgtttatttgtttatgtattgtctattactgcttttaccctgtgatggcagagttgagtagttggcaacagatactgtatatgacctacaaagccacaaatatttactatctgtccatttatttatttatttattcattcattcattcatgagacaaggtctcgctctgtcacccaggctggagtgcagtggagtgatcacggctcactgcagccttgaactcctgggctcaagcaatctacccacctcatcctcccaagtagctgggactacaggtgcgccccaccatgctcagctaattttaaaatattttgtagagatggggtcttactgtatttcccaggctggtctcaaactcctgggctcaagcgatccacccgcctcagcctcccaaagtgctgggattacaggtgtgagccaccatgcccagcctatatggccctttaaataaaaagtttgtggacccttcttctagattcaccagaaaactgcctcagtacgcatgcctgtgggagagaataaccacttatattattttcttttttttccctatacatttaagtagtgttcctttcatccaacggaaaatgaagaaagggactttctttggtccctgcctgtgttcacctttgccaaggacctttctctcatgaatccctctctgctcttttcaaggagggtttcaggttctgtgttatcacccaaattgtgacctttacaaagccccgctggtctgcttggaatttcacatgatgtgcccttctctagatttaggtctttacatgtagtacttgcttatttaaattttatttgcctttcaaggtgccactcaagaaccactccctccaagatgttttcctggatttcctcagcctaaagtaatccctctttttcctgggtgagttatatcttttagtttatttctcttgttaggctcacgttcactgatttacatccatactcattgctttgtgcttatttgtatttgtgagttacattctctaccagattttaaattccttgagggtaggtacatatgttgttcaactttttttttttttttttgagacagattctcgctctgttgcccaggctggagtgcagtgcacgatctcagctcactgcaacctccactccccgggttcaaacaattctcgtgcctcagccccccgagtagctgggattatgggtgcatgtcaccacgcctggctaatttttttttaacagtttcttcatgttggccaggctggtctcaaactcctgacctcaagtgatctgcccgccttggcctcccaagatgctgggattacaggtgtgagccactgcgcccggccttttgttcaactttaaataaattattttttccccatcatcagatgcaaaagaggttcaacaataaaataaattggtaagttcccccatatacttcagatctaatctttagttctccaatgtttccactgaggatttttcctgtgaaatgctggagtcacttcctttgtccgtagtgatccttgtaatttcaagcaccaggctatgattttctattccattgctttgatggagttacttccactagggggagctccttactttgctatatagtcaatttccttctctttaggagacaaaagaagggagacttcctcagacaaaatgtcaaaacaatggtaggaagtagcaactaaaaacatctcctggggcttgactaggtctcagcactagctggctcctcaaatgccatttcacttgtcatattgcaatttggtataattctggcccatgtgtcaagatttccccctacccaatctacttcattcattccatttacaaatacatattgagtacatactttgtgtcaggtattgctgtagatgctggggcttcatctgtgaataaaacagaccaagtccctgactttatggagcttatattcacatatgggcagcggacaataagtgagatgaataaagaaaatatacagtctagtagatagtctagtagatagatatttatctagtagataaatataaaagaaaaaagcaatgcagcatcttgtaggctattgtgagaattttgaatgtgatgggaagcattggggaattttgagtaggggagtgatgtgatctgacttacattttataaggattgctgtggttgttttgtggaaagtaattttttttttttttgagacggagtttcgctctgttgcccaggctggagtgcagtggtgcgatcttggctcactgcaagctccacctcccgggttcacgccattctcctgcctc[134 bp omitted]ggcctcccaaagtgctgggattgcaggcgtgagccaccgcgcccagcctgtggaaagtaaattttaagggggcaagcttgggtcaggggaggaacagtggacttggggagaagttgttggattttggatacattttgaaggtagagccaactggatttgctaacagatcagatgtaggatgtaagaggaatcaaggaaagcagggtcaccatatggcataacactaatagcattgacaaaaatgtgactggtgccccctggagttctgtaacacagcatctctgtccaagatgatgccaagtcttttggcctgaatggtcggaaagatagagttgccactaactgcaatggtgaagactgtcagatgaacagggttgggagtgtgttggaagctcaattttggatatgtttaatttgagctgccagttagacatctaagtggggatgttgaataagctgtgggatgtatgaacctggcattcagaggagtggcctgggccaaagataaacatttttgagtcgtaggcatctacatagtatttaaggtatgatatggacgaaatcaccaaggagtgagaagggttaaagagaaggagaccaaggaccaagccctgagacatctcaacatttagagtttaggaacgtaaagaggaacaaataatggaggctaagaaagactggccagaaggtagaaggcaaaccagaagagaatggtatcctggaagccaagtgaagaaggtgcttcaaagaagagagaatgatcaactgtgaaaaatacttatggttggccaagtaagctgaggtctgggaagttttggtagaatttaacaacttagaggtcactagtagccttgataaaagctgtttcagtggacaaaagcttgattagaatggttcaaaagggaaagagaagagaaaaattgtagacagggagtatagacaaatcttttgaagatttttgttttaaaggtgagcagagaaatgaggcagtaactcaaatggtttgtggggtcaagagagggtgttttgagtgggagaaataattgcaagtttgctctaggagtacttagcgacagttgagttcacttgtacttattcacctgcatttcttgggggtagtacccagtaatcctcagggaaggtagctatcacaggaggggatgttgccaataggtttgagtggaatgaactctaagggaacccatggatgccctttaataaaactgaattcagaacctctgcagttagcagagcagagagtatcttaatgtatggaaaaaatcagggctgtgaggtctagctatccctctcacccacatggtgattccagcctcctttgccaaccttgaaagatctggcctcaagttacactaaagagagtctgagggtctccttccagaaacattatctattgtatggaagggagaggaaaggaagttcttacaggtgctgtgaagctgactaaaaccccagggagtgtttcaactaagtgggaaacttgacataaagattcactggtcatttcccggttccttggtgagaagtggcctcagcagtagaagacagtatagcactgggcttgtttcttagctttgtactttagtagtgatggctttgaaaacacatacaagttttactggtctccatgtagcattttggtttgaatttttttaaattacttttatgtttttgagacacagtctcactctgtcacccaggctggagtgcagtggtgtgatcttggctcgctgcaacctccacctcccgaattcaagcagttctcctgcctcagcttcccgagtagctgggactacaggcacctgctaccacgcctggctgagttttgtatttttagtagagatgggattttaccatgttggccaggctggtctcaaactcctgacctcaagcaacctgcctgcctcagcctcccaaagtgctgggattacaggtgtgagccactgtgcctggcctgaatttctttcctattctcataccttcaaggcccagctcatatgttacctgctctacagagccttctttgagctccctctctggcaaaaataatcatttcctctctgcatctatagtattttttctctttctttctcttagcacatatcacattgcgttatggttgtgtggttgtaaactgatgaggcagtagagtgtaatgatgagagcatgggttctggagctaggctgcttgtattcaaatggtggctcttgcaagttgcttaacctccctgagcctcagtttcttatctgtctcatctcagtttaataataacaatatgactgggatctcataatagggattttgtaaagattaaagagattaacaatgtgaagtacttagaacagtgcccagcacatagtaagtgcttagtgacctttcgttatttgtttctcttcttgctga[356 bp omitted]tattatactttaagttctagagtacatgtgcacaatgtgcaggtttgttacatatgtatacatgtgccatgttggtgtgctgcacccattaactcgtcatttacattaggtacatctcctaaagctatccctccccctccccacaccccacaaaaggccccggtgtgtgatgttccctttcctgtgtctaagtgttctcattgttcaatataaacagaaccaaataccatatttttatctttgtaccactgatgcttagcactgggcttggcagagagtactgggtatctacttaatcaatttttgtgtgaataaaccagatttctaaatcaacttcagttcttctttaatagtttcataggtatatagcccttttatgagatcactcattcattcctgtgtaccactctgtgtagtagttaagaatgaaggttctggagcctgatcacccagtttgtattgttgttttgccagttattggctggatgagattaggcatgatatttaacatctcagtgcctcagctctctcacctggaaaatgaggagaaatataggacgttaaacatagagtttctgaacactcaaaagttaactataagtattattaatcttatcagcaattaagcgacttaatgaacacctacaatgttccaggaattgtgctaacagtggggatgcagagatgaataaggcttggtccctgctctcagaaatcctataagctagtgaaggaaacaagtgtgatcaaatcagtatgtatggagcctagcagaagatgggatcaatttaacaggagggaacagtaacaggaaaaggcagggtagtaagactttatagaggagggaattcctgagctttgcatctgtgggttgacagtcctgggatattaatgtcaagtacatattgaaatcccttttgtggtttatcagagatgagttttataacagatttctcccatcagattttcttttttgtttgtttgtttttgtttcactgaaagcatttacctggaagattttcttaataaggccacttaacaagaggcctccagacggtgatgatctctgtcctcacttggcagcatggtgactgcactgccatgcagctcctccgtctcaccttgccttttgagagatctggctggttttaggagcactgttactggattcaacattgcatctagacttgagaattctttgttcacatctggtttgaaaaagaatgtttgaatggcttctgtctgtcctgtttgcttggaaacagaaacagggctaattgttttatggaaccctcaatctgctatttgaatgaattttatgataaatgcatataaccaagaccagtattgatattgccttctagtttgggggcctaagaaaaattttaatccttctcagaaaatatggaattgtcatgtcaataaatcttgtccaatgcctaaagaaaaagcctcaccctggctgggtgtggtggctcacgcctgtattcccagcactttgggaggc[137 bp omitted]aggaggctgaggcagagaactgcttgaacccgggaggcggaggttgcagtgagctgagatcacgccattgcactccagcctgggtgacagagtgagactccgtctcaaaaaaaaaaaagcttcaccctgccttttgaatcccagagaacctgttctgggccaacaatgcaccaccaggctttcccaagtgcaccaaacatagttttgaatagttttccttgggcaaagctcctctttccttttgaacttcagccagagggccctcacaggcagaagactaaatttcagatgcttctgtcttgccctctccctccctctcaataaattttctgaaaaagttggcatttggattcttcttttcccaccctaacaatcaggcaggaaggaagtagagaatagcatatgttctaagaaaaggctggtgcccctttctagctcacccttttaatagaggcctcttagagatggtgggactggagctacaattaaatttttgagatcaaagacagggtgcagatagatgaaaatcttaatgtcttttgtctctcagaaaaccaatagagccatcgaagcttgtctagttcccccaagtagttaatgagaacaatagaattttgagttcctggtgttctttggagctgattttggcaaatgacaagcagtttgtaaaagggcttattattcgagtagagctttggctgcctgacttttaaggttgattatttgttttgcatgttgtataacaggagtgttgggcaatgctcagaagaggtttttggggtcagagatgtaaggacttctctgactgtcttctcccaacagaaccagattccagctgcggagcaagaggcaagcttgtacacaggaccaaagccatggcttttgtatagccccttaccaccagacaggccttttcactggttcctttagggggagaatatatcaaaatttctatcaagtcagtaacccaagaaaaatatttctctgtgtatgtaatttctcaaactttcattggtgatgtgacctgctttttaaagaaacatttttaaggacatagtttggtcttttgcaataaacagttgtatatggggtccctgtcagctcagtaagtagatgctctgaaaggtagagccttcaactggttatagtgaaaaacagctaagagaggtcttccctcattggtgaagagtgccaagtggatgttgtcccagcccttttgttttcaaggtttaaagtgttgtgcttcctgaccaggtgcagtggctcacacctgtaatcccagagctttgggagaatgaggcaggtggatcacttgaggtcaggagttcgagaccagcctggacaacatggcaaaaccctgtctccaccaaaaatacaaaaaaaaaattagccaggcgtggtggtgcacgcctgtaatcccagctactggggaggctaaggcaggagaatctcttgaacccgggggacggaggttgcagtgaatggaaatcgtgccactgcactccagtctgggtgacagagtgagactctgtctcaaaaaataaaaataaaaaaataaatgaaatgttgtgcttcctatcttatgctggacctgctggctcactgagagatagagaggcaaatattagacattttggagacagtgaatgaaggatgttcctctccctcctattctaaactttaaaagtacactgagccagggcctacaagaaattgagattttttttttttttttgagatggaatcttgctatgttgccaaagctggacttgaatttcaaacaatcctcctgcttcagcctcccaagtagctgggactacaggtgcttgccactatcagatggctttgataaacagaaacttagttgtgtctccttttttgttttttaatgggaacctaatatatgagggagttctgtgtataaaggctataaactagcatttgtgtccagtgccatcagtaaaatgggaagtagcagaaggagatgataggtacctaggaagagatttcatgagctattcaataaattttggatgctttttgatatttggaagatgtgtgtccttaggagagatggcctctacacttgaagttactaattcatggcaaaccattctccttcaaagacaaagttttgctgaagagagtcttgggaaacatgaaatctgatcatcctggtagagtttgtgtctctaaaaggaactatacattgtgggtgtgagtagcttaatttcttgcactaaagtctctggcaccctaaatgaaacactgctttggtgcctatattaatcacgataggctagaccgatacagtgacaaatagcagaggtttatttgttgctcacataatgtttgatatagactggttggtcctcttctgtcttgtagctataccatctggaacagatgacttccaaggacaccgtagcaaagaaaaagagaactggaagcccatgtgccttaatcgcttcatcctagaggtaacacagaacttctgcatacatttcattggcaggaactaatcacctaaccccaatttaaccacaaggaagactgggatatgtagaggcatagctagtagatttcacgtctattaacagtctctgctataccccctcagtaccaactgaccactaacttcccaccccactcaccaggaatgtatagctgctgatgattttcgaattcggtaagagactggattgtgaatatcagaccacctcttcagtctaacagacagtgcttgttttacctaaggtgaggagacagcacaggcagtactcacttgtttgtcagttacagtccttttcctctccctctctcattactcaccatgaaacacacattgtcccttctacttctgtcccaagcgtcacactcataagaacataagaagtgcccccagatcaaacaagagtgcttgaatagaaagtgagatatttcttctttataaggttgaccttacaaggctgaggcaggctatgcctaattatgtagggaccctaatgtctcatggttgtgtcagcataaattaattaatgattaaccctctaacaaggctaagtgaacagaattccccagtgtcctgagagaaggaaagttaatgtgttctttctcccaggaggaggataaccagtggagccttttctggatttctcactagaagtaaagaccaaatttccagaaggaacctgagagataaaaagtggttggctgctcctgacctgactcatagtgtttaactgaaccataccactagtgtatactagtgtgtgtgtatgtacatgcatacacacatgcacacacacattcacacacaatcctatggtatttggtgactttggatgcccagctcttgcaacaatttcctgctgtcattcttttccctttgaatctcaggggtgagcaaactaaagaaatactatcatcttactgcttttagtatattccatagaaaaggagtggctggagtcagtgtagatcaacccaagcagtacaaatctgccagaattgcagctcagcttccttacctccagcatgtgtacctttctgaagggtaggcccttaagccagacataagtaagttatccactctgtgcataactgtctgacttggcttagaagcatgaaaggggcagaaatgtaagatgggtaaagaagggcttcatctgaaatagggccatgatgattagctctctctttccttcctttggcttcattgctgtattccatgtgggtcttgatatcttgaaactggatgagatacccaaatagtcagtccctgaatataaatcatttccttgtacagaatcactgccaaactcagtatggttaaaagatttttaacacccagctgcagcattcactctggttagaattggccatttaaatttatttcacatatgtaagtatcatatcctttataatgcattcttaattgttgctcagttcttccagattgaattcctttaaaaaattccttatgtaatcttttaattctagttggaaaacatcacttgacagttgctgtttatacaggcatgcctcgttttattgtgcctggctttattgtactttgcagatactgtgtttttcacaaatggaaggtttgtggcaaccctgcgttaagcaagtctgttggcaccattttctcgacagcatgtgctaactttgtctctgtctcacattttggtaattctctcaatgtttcaaactttttcattatgattacatctgttatgtggagctgtgatcagtgatctttgatgttaacattgtaattgttttggggtgccacaactgtgcccagataagacagtgaacttaattggtaaatgttttatgtgttcagactgttccactgactagcccttcttcaaactctctcactctccttgggcctccctattccctgaaatacaacaatattgatattaagccaattaataaccctacaatgatttccaagtgtttaagtgaaaggaaa[135 bp omitted]ggtgaaaccctgtctctactaaaaaatacaaaaaattagccgggcgtagtggcaggcgcctgtagtcccagctacatgggaggctgaggcaggagaatggcgtgaacctgggaggcggagcttgcagtgagccgagatcgcgccactgcattccagcctgggtgacagagcgagactccatctcaaaaaaaaaaaaaaaaaaaaaaaaagctagaaatgactaagctaagctaagtgaggaaggcacgtcaaaagcccagcgaggcctcttgtgccagccagttagccaagttgtgaatgcaaaggaaaagttcttgaaggaaattaaagtgccattccaatgagcatgtgaataagaaagcaaacagccttattgccgatatggagaaagttttagtgatctggatagaagatcaaatgttttcttaagccacgatattcccttaaaccaaagcctgcctaatccagaactggaccctaactctcttcaattctatgaaggctgagagagatgaggaagctgcagaagaaaagtgtgaagctagcagaggttggttcatgaggtttaaggaaagaagctgtctccacaacacaaaagtgcaaagagcagcaagtgctgatggagaagctgcagcaagttatccagaagattaactaagatcattgataagagtagctgcactaaacaacagattttccatgtagacaaaacagccttatattagaagaagatggcatctaggaatttttttttttttgagatagagtctcactctgttgcccaggctggagtacagtggggcggcctcagctcactgcaacctccgcctcctgggttcaggtaattctccctgcgccagcctcccaagtagctgggattacaggcgcccgccaccatgcccagctaatttttgtattttttagtagagatggggtttcgccatgttggtcaggctggtcttgaactcctgaccttaagtgatctgcctgcctcggcatcccaaagtgctgggattacaggcatgagccaccgtgcccggccagcatctaggattttaatagctgcagaggagaagtcagtgcttggcttcaaaggttcaaaggacaggttgactctcttgttaggagctaatgcagctggtgactttaaattgaagccaatattcatttatcattctgaaaattctagggtccttaagaattatgccaaattctgcttgtgttctctaaatggaacaacaaagcctgaatgacagcacatctgtttacagcatggttttctgaacatgttaagcccactgttgagacctactgctcagaaaaaaaggttcctttcaaaatattactgctcattaacaatgcacttagtcacccaagagctctgatggctatgtacaaggagattaatgttgttttcatgtctgctaacacaacatacattctgtagcagatggattaaggagtaatttagaccttcaagtcctatttttttaaaaaatacattttataaggctgcaatggagctattcctttgatagatctgggcaaaggaaattgaaaaccttctggaaaggattcaccattctaaatgacattaagaacactcatggttaataggaggaggtcaaaataccaacgtggactgtaatcccagcattttgggaggccaaggcgggtggatcacttgaggtcaggagttcaagaccagcctggccaacatgctgaaatcctgtctctactaaaaatataaaacattagccgggtgtggtggtgggcgcttgtaatcccagttacttgggaggctgaggcaggagaatctcttgaacccagaaggtggaggttgcagtgagccgagattgtgccactgcactccagcctgggcaacggagtgagactccatctcaaaaaacaaaacaaaacaaaacaaaacaaataaacaaacaaaagacaaaaaaaaacccaacattaacaggagttgggaagaaatttgatatggttcagatctgtgtccccacccaaatctcatgtcgaattgtaattcccagtgttggagctggggcctggaggaaggtggttggataacgggggtggtttctcatggcttaacaccatcccccttagttgccgtcatcacatacttgtgagatctggttgcttaaaaatgtgtatcacctcctccccgctctctttctcctactctggccatgtgaaattacttgctcttccttcgccttctgccatgattggaagcttcctgagacctccccggaggctgatgctgccgtgcttcctgtacagcctgcagtactgtgagccaaataaacctcttttctttatatattacccagtctcaggcatttctttatagcaatgcaagaatggactaatacaaagttcattccaaccttcatggatgactttgaggggttcaagacttcagtggaggaagtcactgcagatgaggtggaaatagcaagagaactaaaattagaagtgaagcccgaagatatgattgaattgctgcaatctcatgataaaacttgaacagatgaggtattgcttcttatggatgagcaaagaaagtggatttttgagatggaatttactcctggtgaagatgctgtgaacattgttgaaatgacaacaaaggatttagaatatgacataaacttagttgataaagcagtggcagggtttgagaggactgactccaattttgaaagaagtttcactgtgggtaaaatgctatcaaatagcatggcatgctataaagaaatcttttgggccaggtgcagtggctcatgcctgtaatcccaacattttgggaggccgaggtgggtggatcacgaggtcaagagattgagaccatcccggctaacatggtgaaaccccatctctattaaaaatacaaaaaaattagctgggcatggtggcacatgcctgtagtcccagctgaggcaggagaatcacttgaaccccggagatggaggctacagtgagccaagattgtgccattgcactctaacttagtgacagagcaagactctgtctaaaaataaataaataaataaataatcttttaggccagtcgtggtggctcacgcctgtaatcctagcactttgggaggctgagacgggcagattgcctgagctcaggagttccagaccagcctgggcaacacagcgaaaccccatctctactaaaatacaaaaatcggctgggcgtggtggcgggcgcctgtaatcccagctattcaggaggctgaggcatgagaattgcatgaaccctggaggcggaagttgcagagagctgagatcttgccactgtactccagcctgtgaaactctgtctaaaaaaaaagaaaagaaagaaagaaggaaagaagaaagaaagaaagaaagaaagaaagaaagaaagaaagaaagaaagaaggaaagaaagaaggaaagaaggaaagaaagaaagaaagaaagaaagaaagaaagaaagaaagaaagaaagaaagaaagaaagaaatctatcttttggaaaggaagagtcaattgatgtggcaaacctcactgttgtcttattttaagaaattgccccagccaccctaaccttcagcaaccaccaccctgatcaggcaggagccatcaacctcaagtcaagacctcccaccagcaaaaagattatgacttgctgaaggctcagatgatcattagtattttttagcaataaagtatcttaaattaaggcatgtttattgtttttataggcacaatgctattgcacaattagtacactatagtatagtgtaaacatgacttttatatgcactgggaaaccaaaaaaattgtgtgactcactttattacgatattcactttattacagtggtctggaacccaacccacaataccttcaaggtatgcctgtatttcccctttctttcccagtaacaaaattttaattcttcaatttcacattttcccgtcttcctcttcctattttgatctctgctgttggttgccactttctttgctaagtttcctttcctttcccaacatcaaatcctaagttttattcccttttctgtatatttaatttcagttattttgtgcgatttctagcacaacttttaagtaactgaagatatataactctgagccagttagaatcccttagacttatgtgatccttccaaggagttcaaagtaattcaccttaaaaattaaactattccactgtagtacttcatttatcatctccagatatctggagactaggtaggggcgacttttacccttcctattttaagaatggacaaatcgagatttcgagatgataaataacttttccatcatcattatcctgctggttctttgatgtccagaccaaagtaatgaaatgatgacctgtgaattctacattattacctccttccttgattaaaaatgacactgggacaggctgagggagactgctgtgcattgtatgggagtgaataatctggcagaggcagaactctatagttaggcatccctaaaaggcagggaccccagcatctaaacaatcctcctttgatatcctgtgtctggctgggcctttggcatctggcccagcgctcccagcagaaccctgtggtaatccttgcctacagagtatggggatgcagtgagcatttagctgccaagaatgttatagacaatagaaatagagaagtttcaagtgttccttcctagagtagcaagtgacagcttaggatgggagggagaatggccttctctatagcttaccaaatgagttagtgactatgaaagtggtttctaagtagtaaaaatatggaacacacgatggttattgctgtgacattataaattgcctgtgttgtttttcccccaaggtttgtaagaagaccacagagatctcaaatattgctacagtcatgagctcagcctcctgagtagctgggattacaggtgcccgccaccacatctagctaatttttgtatttttaatagaagtaacacttacagttcccctaggcacaatgcagagattctcctctgtggaagttagagcaaattccccaggctagtgttacccctgctttgtcagcacttacttcattttctgaaagaagaatctggcgtggcttcatctttattcctaattgttcttcccaattttctgtcattcaaagccttctgagctctagggagttgagtggaggacaggggagcttgaggcatggcctgatcccaggcttatattccatagtacagcatttatccccaggtcgggcctctggcatcctctgctctctgaaaatctgctccaaatctggatggaagaaacagtcgcaaactccctcaaacacacagaggtagccttacagcattaaaggtctgttattcttcagacattttctagtcccttgtttataacgtagctctaaagagtcctgtaatctggttacctagctgcacagattagaagcaacaggcagatatattgcagtgggggagggagggaagaagctcagacaaactgatggaggaagtgcctgctgaaggcctgaaaccctgggaggaggcaggaaaacaaaatagcataacgtaatgaaggatgtgattgtgattaccctgagtaagctggaaaaaggttcaagtgggctggggaatctggaaaacatgttatataaacatgtatatttcacatgtcatgaaaatactgtttaaaatttttggcatttaagggataaggttcccttatctatacaaatccagttatttctaagtctgccataactcacctaaaccagaattatgagtatttcctatagtgacaatataatgcttttttatagtaaggatttgaagccctgtttttgtgagtgtgattcaggcatcgtgtgagaatgtgattggaatgctgaattcattcattccctgatttggtacgcatatagaagtgttagccaggtgcggtggctcacgcctgtaatcctagcactttggaaggctgaggtgggcagattgcctgtgctcaggagttcgagaccagcctgggcaacatggtgaaactccgtctttactaaaatacaaaaaattagctgggtgtggtggcgctcgcctgtagtcccagctactcaggaggctgaggcacgagaattgcttgaccctgagaggcagagaggttgcagtgagccgagattgcgccactgcactccagcctgggtggcacagcaaaactctgagtccaaaaaacaaacaaaaaaaagtgtcacatttcagccttcatacaaggctctctcaaccgcccttagacttttcctcacatttctttcattggcccaggagttgcttttgatcctccatggaagcctgagctgtggaagactgcatctcaggactggaggtcccaaacaggaagtgacttcaatcttcaggaaagtcactgcctggttgtcacctggattcacgttcagtgtaccgatgaactaactagcccagtgcatttgtcactgcttctgagtcaagcctgggcagggcacagaggctggtgtacagattctaccttgtgaactgtcctgctcgcaaggccataagctttctgaacagctgctgtgaactggcaggtgctgggtgggaggtgatgctggttgtgccagagctttctggtgctgtcatatgcttctacaattacctcccttcttttgcttgcagattcatagtttggccacacatctttgccagcaggaaggtctgttttattcactcctctcactgaccctccccccacccccagtccatgacagagagtatgattgacttggctcaaagcaaagaagcagcaaggctgcagagcccataaagcagtcagaaacatgtctcacttagctcttgtaattgtgatgtcttggcttggccttttgccacccttccctgttctggtccttaacatgcttcaccgaggggtagttgctaattgggaaatttagtgcatccttctttgaggatgattgttatggctatagaactgcaaaataggacactaagatgtggtggagcactggacttagaatcaggaagcctggtcctgattctaatcatattctggtcctgggtcagctgtggattgctgtgtgatcttggacaaatctcttcctcatctgctggaggggcaaggggacaatggttatactagtcaatctctgagatctaagcattaaatcttccattttctttcctgttcatgcagaaagaaatgttttggttcatttcctagaatgtcttctctttttctctgtatccacgtctcctttcaccagaacctgtcttttggtgaagcaattactcatctatttcattttaaagcttccctgggaatatggaaagattgtatagaggtgcctaggttctaggagtttttattttgaaaccgatgtatggaattcaagattaatagagttattgtagtcccatctggaattttaatcactgaatcacagggagagcagccaagccaaccatccatgatgcagttagatttggaactagacatctcagcctcagttctctcctgcaagtgactggggtgggagcagaaggaatatgctatcccatcacctcccatcattagcactgcccagaaaaagcagaggagagactgaaaagggtgtggtagcaaacttggacaaggataccagacaagtggcagactttatgaaatgtccactgtttggcaaatgagccaggcattgtggagcagggagactaaggacaactttctacaaacaaaccctgcctgttcttgcttttgggcctatatcaagttttctccaattggcatgccctccttttcctcgtagcttattcaaagtcctacccatccagcaaactccacctcttctatttaagttcagcagacctttattgaggaccacccaatgacccagccctcctttaaggatacaaagatgaataaaaacttagtgcctggccttgggatgacagtaatatattgtcctgcttgggtcactgttgtttcatgtgtgtttcttttccctctgcagctaaactgtaagctcttggagggcaaattgtgttttgaggggtcccgcaatcaccccaagttgggtgatttactagaaagactcataagacccaatagcaggttttacttacagctaaggtttattacgccaaaggatacagaacaaaagctgcaggaaaaatatacattgagtaggcacaggttttcaagtcctttcttatccatggctgcacaggagcatctaacaaattaacagcaaactacagggacacctgtgaaatgtctctgtctaggaaagcccacccaagtctcagagtctctgaggcttttgcgaaatgacactcaggatcccaacatcaaaaccaggtacatcatgaatcttgcaaaaacaatccagagaagtcctgacaagtagatacagtatacctcattgctctggatgtataaaatgacatcaagacatcatcaattggtgacataaagaacatctgagggctgtattcccagaggtaggcctaggggcaatcataattctaggctcccctgaagatgtgcaaggactgatcaattagagcttctgtgttaaccctttcttcaacgctgtgtcttacacatttcatacatcccctcagagtgtttagcacagacaggtcctcttctctaagcccaagactcatatatttcactatctcttatgttcattcccacagacatcagcacctcaacatgtacaaatatgaactagatttccccccttaccccactttctccatctcagtaactgtcaacatcattcactctgttgctcaggcccccaaatctttgttttccttttgattctcctctccccgtcacttcccacaaccaatcaggaattttcttttgactctaactttgaagtatatcccaaatgtgatctctcatcctctcagccaccctagtgtaaaccatcatcatctttcatctggaccacttgcctcctaaatgtttcaatttgtttcctctatagcctgttctccactcaccaccaagagtgatccttcaaaatgtacatcagactatgtcacttctggctactcacaacctccaattgttcgttaatatgcttggaataaaactgaaacattttactctcttgctcacttattgtgctctagcctgagaccccgtgaatgagtatgtttccttctcacatgacattcctttttccaggactgttcttcctctaacgctttaaatgcctggatgcttttcctttaagtgtgaccttcactatcagcccctcatggagactttttctgatcaccctatctaaggtagccctgctcctctgctcacctgaaatcataattgtttatttgtttatgtatttgttgtcactctacactgattagactataaactcatgagagaagacctttgtctctcattcataatgatatcttcagcgcctagcactatgccaaatttagagtaggcttccaataaatatttgttaatgaatataataggttattaataaatatatttgattacttaaaagtgatgaactggcctctgcccttaaaaggtttatgttctactgaagagttgagtaggaaagaaactcaaaatagatggaaaacttttctgtgttgtccgggatccaacataggacatatcagcattctggacagcagaaaccaacaagcaacagagggaccacatcaaacagctggaatctatccagctcagcattctctctggcaggggtttctggggtctgtttgaagagagatacaagaagcttggaaattccatgtggaaagcaaggatcgtggagagttgatgtcttctttagggtagtggcagtggagtttttgccagcgaagcacccacagtatggctgcaccttgtttctggcctcttcagggcctcgctttatgggtcgccagagatcctgtgggtggtctaatattgtttaataaatttcctttctgcttaaactagtcagagtggattttgcagtttgcagttaagaactcagacctatctaataggttgaaaaacaaggttgaacttcagaatggtgacttgtaactgacatctaactttgatagaaagtgttaaaattatactgatgttggaggcattacttcaaaactgaaccaaaacatatagccatatcaaaatgacatgctaagtttgagacaaagcaatttatttagtcacatccatgggaaaaattgtatatgttttcatgtgtctataaagcactattgtcaaaaatgagcatttttaagcatttacttctttaagttgattgctattataatctggtgtaatttttattacaagtatatcagcaactaaatgaaaaacacttaaaatatttttaaaaggcaaaactaaactattacgtttaaggttgcaacctgagcgataaaactataatgaaatcaaggaagagaggaagagatttccataaaagtcagcgtagtggttaattttaggattgggatgggacatgtgccaggcttctaaggtagctagcaaagttctatttcttgacctagaagtaaatatctaaaagtgtatttactttataatactctattaagatatgcatttttctattattatatcttgcagttaaaatggttaaaaatatgtatatcaactactcaaatgtgaattatttttatggaaatgtcccctgtatgttttcatttcaggatccctgaggactttcttacggatttttgtctgtgggaacttgtgaattaccgtatgagcttagcaggagagttaacttaaaatgtttattgtcccttatgactgggcgcggtggctcatgcctgtcatcccagcactttgggaggcagaggcaggccaatcatctgaggacaggagttggagacaagcctggccaacatgctgaaaccctgtctctactaaaaatacaaaaattagccaggtgtggtggcgcacgcctgtaatcccagctactcgggaggctgaggcaagagaattgctcaaacccaggtggcagaggttgcagtgagctgagatcacatcactgcactccagcctgggcaacagagtgagactccgtctcaaaaaaaaaaattaattatcccttataatcaaagttatgcaaatgaaaacaagacaccattattccccatggaactgtcaaagatgttttaaaaagtgttattactcagtgttggtgaaagtatggagaaatggatacttatatatgccctgatggcagaaatgtaaatgactataatctttttttttttttttcttttgacagaggcttggcctgtcacccaggctggagtgcagtggtgcaatcttggatcactgcaatctccgtctcccgggttcaaacgattctcttgcctcagcctcccaagcagctgggattacagacgcctgccaccattcccagctaatttttgtattttttttcagtagagatggggtttcaccatgttggccagactggtcttgaactcctgacctcaggtgatccacccgcctcagcctcccagagtgctgggattacaggtgtgagccgctgcacctgaccgactacaacctttttgtaaagccattttgaagtctgtaacaagggcctaaaaatgctcattttttttttcttttgagacggagtcttgctctgtcaccagactggagtgttggggcacaatctcggctcactgcaacctctgcctcctgggttcaagtgattctccagcctcagcctcccaactagctgggactacaggcttgcaccaccaagcccagctaatttttgtatttttagtagagacagggtttcaccatgttggccaggatggtctcgatttcttgacctcgtgatctgcccacctcagcttcccaaagtgctgggattacaagcgtgagccaccacacctgggcccaaaatgctcatttttaggaaactttaacccagtaaactcaatcctaggaaatttatattaaggaaatagtcagaggtgtacaagaaaatatatgtacagggatgtttcttgcagtagttttgtaatagtaaaattttggaaacaacataaatgtttaaccctagggaaatggtacagtcacaaaacaaaatattatacagccatcaatatgagtagttttgaatgtatacacatagaagataataatgatagtgatggccaacatttattgatcactcaatatttgccagggactatgaaacctctttacatgaattatctcatccttgagataatactgtgaggtgagtactatgattattctcattttgtaaataacaaaactgagactcagaaagtttaagtaacttgcccaaggtaagtaagcaatagagtcaaggttaaatactccaaatttacataaaggctgttaaccctagtaatctttaagtgatgggattatagttatttttgttgtctgctttatattttatttatttatttatttattttgagacagtgttgctctgtcgcccaggctggagtgcagtggcatgatcttggctcactgcaacccccaccttccaggttcaagcaaccctcccacctcaacctcctgagtagctggtactacaggtgtgcgccaccacacctggctaatttttgtgtttttactagagatggggtttccccatgttgaccaggctggtcttgaactcctgaactcaagtgacccatccacctcagcctcccaaagtgttgggattacaggtgtgagccatggtgcctggcctctactttatatttctctttatgcttataattttttatttttttaattgataaatgataattctatatatttatggggtacagtgtgatgttttgtttgatgcatgaatatattgtgaaatgatcaaatcatggtaattagcatactcatcacctcaaacatgtatcatttttgggggttgagagaggatttagaatcctctcttctagttattttgaaaaatcttaattttataaaataaccacttattacttttgtaatcagaaaaaaaaaaatagctcttcccagatattcttgccacacagagatgcactgacttctggggaaagtgtcctgggatgaggttagggccaagggtcttgaggcaggaaataatacaaaatagttctgtcacccaggctagagtgcagtggtgcgatctcagctcactgcaacctctgcctcccaggttcaagcaattctcctgcctcagccttccaagtagctgggattacagacgtatgccaccacaccaggctaattttttgtattttttgtagagactgggtttcaccgtgttagccaggatggtctcaatttcctgacctcgtgatccacctggcctcggcctcgcaaagtgctgggattacaggagtgagccaccacggccagcctgtttattttttattttttatttttttgagacagagtctcactctgtcgcccaggctggagtgcagtgacacgatctcggctcactgcaacttgtacctcctggttcaagcgatcctcccacctcagcctcctgagtagctgggattacaggcatgcgccatcacacccagctaatttttgtagttttagtagagacgggatttcgccatgttggccaggatggtcttgaactcctgacctcaggcgatccgtccgcctccgcctcccgaagtgctgggattataggcgtgagccactgtgcctgacacaaaatagttttcttgtgctcagcttccccttctctgtgaatagtccagttttttcctaagaacattacctcccaactacagactagaaacttggctgcctcggtttggacccttgcttctgagcaagtagaatcttgctgaagaagggaatggcatgtggggcagtgacaaagggcaggaactacctgctttctgaatttcctactaaatttcctacttaaagccctgcatttcacactatccccctcatagctgtgggttatgcatcaggagttctgatttggtgcctcttgtttacttctctgccacctctgcctccagacccagggtcagggagcctccttttggctctggctgggcagccaccttggttagtccagaaggactcgtggctcccagagggtcatcatagcttggtactgttccatcgtatgtcagctactccaccttccacctgatcacaaccagtcttttcccaaacttggatcttttgaggaaagatgagacaagaaaatgtagcagactccatgtgaacccttctctagacctaggaaaacttattcaatactcctccttactaagagctaatcagtatatgaaataaagacactcaggaagtttgcctgaaggttaactcagagacctgggagtgaaacctagctctcctgcttcctaggcccctctgtgccatctatttttagccaagctgccctgagccttgtccatcttgtctgaaagccaaagtaggcacacagtttgctcataaacattcctgtgcttgccagctcatgctagccaaccatttagatgttggttttaaaactgcgagccttcccttgtacctacctcctaaggcctgcaaagaatacacaccaagggatcaatagcctgagtttttcccgaagccaagtgacctcagtcaaatgccctcaattgagaggcgtgtctattactcgttcatcttggcacagggtgcagcaaatgactccctctcagagccactgttcctggtcacagttctttgagtgtgctgacctactttctccccttcacaggaaaaacagaaaccaataaatgtctccagtgagtaatcttgctttcaggagcactgactctgtgttttggcctcttgtcctttccctgctccattatcactctgctataaccataagaaaatggttcatgactgaactagaactctgtttgttgtttactgtccccattctgtagctgggttttcagagcaactatggcccacatatcacagggatgggggcagagccctccctacctttcctttccctactacaattcattgctaaatagcataatgtggactaaagttgcttctgcacaagaatgttgggaatcaacagagtatctctggttttggccacacatgctatgcgactggtagcattatggactgagaggcattcagcttgagactcctgacttaacttactatatacctttggagtgggcctctaagaagagtcaggtggctcaattcggttgccttgacaagcagaacctctttactgagcgtgtacaggtgactctcaaatacccacactgagattctctgtggctaatggattattttaggctgtccttacccttcacagtcttcatgctattgcccactccctccagccatcatctggaagcaacttggaaatatatgctcattttaatgtcagtctgagaaaagttaactagaggaataaatctactggggttcagaggcaaggtgttgataggacatataatgtattccagagtgccttttggattatctaccggtttttaataacctggcatgtctgttcttcatgaccatggataactgagtatatcttattttgctcccctatccctgggcactgtgtctcctttcttcctcacttgtccttgtgtgtacaacagattataaccagcttgccttctagaatcctgtcaaatttcatttatatcgaatgtgctggccaggtgtggtagctcacccctgtaatcccagcattttggaaggccgaggtaggaggatcacttgagcccaggagttagagaccagcccgggcagcatagcgagacctcatctctaccaaaaaaaaaaaaaaattaaaatagccaggcatgatggcacatgcctgtagtcccagctacttgggaagctcaggcgggaggactgcttgagcctgggagattgagactgcagtgagcctgggagattgagactgcagtgagctgtgatcatgtcactgcacaacagcatggacaacaaagcaagaccctggctcaacaaactggaagtgctaacatgggcttttaaaaaggttccaagtccttttcaccagctccaaagtcatattcgaagtctgggcaacatggaaaaactcgtctctacaaaaaatacaaaaaaatagccggccatggtggcacacacctgtagtcccagctacctgggagtgtaaggtgggaggatcacttgagcctgggaaagggaggttgcagtgagctgagattgtgccagtgtgctccagcctgagtgacagagtgaggccccgtctcaaaataaataaataaataaataaaatcaatatacattaggaagcaatgaggttttttttttttttttaaagcaagttgtagacagatatatactggatgatactgtttttatcaacttggatagaaattaatacacaaacaagagtatattttgtttgaggataggtatatatgtagcaaaacacagactgaaagactaagcctaattcatgataagtcatttcaaccacttcgtatcattccatcatgtaaacgtaccctgattatttatatattatccttttgatggacatcagcttctttccaatttttgtattttgcaagctgtgctgcaatgtacatccttttatgtgtctcccagtgcatatgtgcaaaaagtttccctacaccaatgaatacctagaattagaattgttgggtcctatagtatgcttactttcaactttacaaaatattgctaaattgttttccaaagttgttgtaccagctgggcacagtggttcacaactgtaatgccagcactttaggaggccaaggtgagaggatgacttgaggctaggagtttgagacctgcctggactacatagcaagaccccatctcaattaaaaagataatacaaatataaaatatatataaagaaaaaaaatcatattgtagtcatagtggccacaagaggctgcacttcagcaactagcttatctcaggccagctgggccagggttagagtgaacccttcctctgaagagctgggcaggtagcaggtggtaagataggacatggctgcaggcaacagccaggaatctctacttctggagtagccattcatacttgtggttgtaaagcatgtgtcccccacccaatcatctgggttggaggtaggatgtggatgaatgacaacaggacctctgcattcacagaactggagaggggagggggcaactgggatggggaatgaggatgaatcgcaagcagcagcagaagtgaggagaacagtagggagatagaaagggtaatattgctagtcaccaaaacaatgggacaaagatcccaaagacatttcagagatcattgagtaggttgtccctcccattacaaattcagagcagggccttgagggcagggtttccagaaaggtgcccaccagacctcagcattcactgcccagggccacctcaggactctgcttcccatgttttggtgaagagctccttggctgctccagccatggctcaagtgagcccatgtgcagttcatgccactgctctggagggtacaagtgtaaaccttggcagcatgcacagggtgctgactctgcagaagtgctgagcgcatgagttatggggccattgtggcatctacctagatttcaaaggatgtatcggacagtctgggggcccaggcagagacttgttgcagaggcagagccactgcagagagcccccactagggcaatgcctagtggagctgtggaaagcaggatcctgcagagtctccactagggcagtgcctagtggaaccgtgggagtgggaccaccactgggaccccagagccgtagagctaccagcatacagtgccaacctgggaaagctgcaggcatgagactccaacctgagacagctgaaacatgtgctgagcccaacaaagccatagataggggcagggctgcctgaggccttgggggctcagcccgtgtcttggtgtgcccaagatgcaggacatggaatcaaaggagattattctatacctttaagacttaatgtggttttctttgttgggttttggacttacttgggacccctttcttcttgcctatttctcccccttggaatgggaatgtctatcttatgtctgtcccactgtattagtccattcttacactgctataaagaaataccaggctgggcacggtggctcatgcctgtaatcccagcactttgggaggccaaggggtgcagatcatgaggtcaggagatcaagaccatcctggccaacatggtgaaaccccatctctactaaaatacaattagccaggtgtggtggtgcgtgcctgtagtcccagctactcgggaggctgaggcagaggaatcgcttgaacctgggagacagagactgccgtgagcagagatcacaccacggcactccagcctggcaacagagtgagattccgtctcaaaaaaaaaaaaaaaaagaaagaaagaaataccagagactgggtaatttataaacaaaagaggttaattggctcatggttctgcaggctgtatgtagattctgtaggttctgcaggaaacatggtgctggcatctgctcagcttctgtggaggcctcaggaaactttcaatcgtggcagaaggtgaaggggaggcaggcatgtcttacatggctggagcaagaggaagagagaggggaggtgctacacacttaaacaaccagatttcatgagaactcaccatcacgagaaaagcacagaggggatggtgctaaaccattcataaaggatccacccccatggtccaatcacctcctaccaggccccacctctaacactggagtttacgattcaacatgaaatttgggcagggacacatatccaaaccacatcacccagcattgtattttgtaaataaataattttgtttaatttttaatctgtttcctcacagctggaggaaaatttgcctcaaggtgaattatgccttgagtcccacccatatctgcttttgatgagactggactttggatctttgagttgacactgaaacaagaattttctggctactgcaatggaatgaatgtatttcgcattgtgaggacatgaattttggggaccagaatagaatgccatggtttgaatgtgtcccctaaagttcatgtgttggaaacttaattcccaatagaacagtgttgggaggtgggacataataagaagtgattaggtcatgagggctctacccttattaatagattaatgtcattatctcaggagtgggttagttattgtaagagtggctgcattataaaagcaagtttgactcttcctgttccctcgctcttaccctctcttgtacttctgcctttcattatggcatgacgcagcgtgaaggccctcatcagatgctggctccatgctcttggacttcccagcctccagtaccatgagccaaataaatttctgtttattataaattacgtagtctgtgatactctgttatagcaatgtaaaacagactaggacactctgcctgtttcaaaaccctccaggggcttccagttacattttgtataacgttcaagctctttactttgacctaataagatatagtagcccttaccaaaatatctgatctcatcccatactatgttatttgtttatgatgcttccagctataatttgttctctcttcagggcctatgcaccctgcataaaatgttctcttaccatctttctcatcatccacatctcagctctagggtcagctcctcatagaggctttccctggtcatcccaactaaggagccacctactctgatcagtatctcatcatatcaccctggttttttttttctctctctctctttttggcggggcgggagtggggttgacctgggctatggctgggtcaagtgcctgctttattcaacaggaaatgcccaagtgggactcacccccacctttcacagtgtaaatgagcagggagcaaggcaggaagctagaaaaataacacatggatctagacgatccagaaagaccctgttaagtcagctcaaggccaagactggtcagcgtgagagaataaaagaggtgacggaaaagccttgggcagcctgggccatgatgggcctagcggaagtagttgggacattcgtgggcaacaaaatgccaggtttgattaaaagtgtccatgacagccgggtccatgggcccttcctccatcactgccaagttctgctccagcttctccaggctggacatgcccaggatgaccacgtctctgtgggcaccctgcagctgtgagtggtggtacatccaccagagggtgggtggccaaggtcatgctgggggcactgacaccatacacggcctgtgtggccttctgcatcagggaaatggcctcaaagtggtgctccttccagaagcgattcctgtgggtctcagcccagctattcccaaagaagtggcccccagactgtttcctgcccttgtcctcatacttgtacttgccggtcagcagacccccagccagagggttgtaggcatagaacctcagtccaaagtgcccaaggcaggggaagagctccatttccacctgccgggtggtggcattgtacatgccatggtacacagtgggcaggatccagcctttgctcttatttatttatttattacttttctttttttttggagatggagtctcgctctgtcacccaggcgggagtgcagtggcgccatctcggctcactgcaagctccgcctcccgagttcacgccattctcctgccttagcctcctgagtagctgggactacaggcacttgccaccacacccggctaatttttttttttttttttgtattttcagtcgagacggggttt[132 bp omitted]tcggccacttcccccagccggcatagttggagaggccaagctccacgaacttgccctcctggtgtcgctggtggcaagcacacagcgtctcttccactggggtgccgtggtcaggtgcatgtaggtagaagaggtccaatcggggacactgcagcctcttcagtgacgtctctagctgggaccagacactgtcaggctttagtgattttccctctcaagggttggccttggtggccaatttcactcagcagtcgccgccgcccagccccagcctcaggccgcccaggatgattttggactggccatcgctgtacatgaaggccatgtccagctcggtgtggccacgctccaggaaagcgtgcacggccgtggcgctggcagatgtgtccatgtggcgccccatctccatgatgcccagcaccatggtgcgccgggccaggatgcccaaggcggcctgcgttggttgtggaagggacatggcgagcatgcgggcctcgggtggcagggagcgacttgtgcagtggatggcggcttggggcatggtgcgagacgcggtgctcaacatgaccatggtgcctgcccctcaccctgttttattttctccctaccacttaacattatctgaaattgtctgttcatttattggcttgcttattattatatatcttcaccgccactagaatgtaaatttcatgagcatggcaatcttatttgcctcagtcctgctgaatgtctagcaactagcacagtacttagcaggtgctcagtggattatttgttgaataaatgagtcaggatatggactggcattgttgaaaccatgggaaatatgtgatcatatgatcacttcaaggagagcctgaagagttaaatgtggattataaaggaatgagcagaggaaagaatgcctacaaagcaatttggaggaacaaccagggaggtaggaggagagacaggaaagtgtgatgttacagaaggcaatcctacttctctccccaaaagcaaccaatgctaacagatgggtgggtatccttccaaatcatgttctatatatttacatacattcacaaatgtttatattacatgcatatgtagttttggtttttatataaatgagctcatagtacatgtattattctatcatttgcttttttttaaaaaagaaataacagctttattgagctataattcacacactacacaattcacacatttaaagtgtgcagttcaattatttttaatatattcatggatgtgtgcaaccactgccatagtcaatttttagaacattttcatcacctcagaaggaaaccctgtatcctttagctatcgcctctttatccttcaacccttaccaaccactaatccactttcagtctctatagatttccctattctggactttgatattaatggaagaatatgtgatcttttgtgactggcttattttacttagcacagtgttttcaaggttcatttatgttgtagcatgaatcagaacttcattctttttattgctgaataaaattgctcttggaggccaggcatggtggtgcacacctgtaatttcaacactttgggagggtgaggcaggtggatcacttgagctcaggagttcaagaccagcctgggcaacatggcaaaaccctgtctctacaaaatacaaaaaattagctggatgtagcattgtgttcctatagtcacagctacccaggaggctgaggtgggaggactgcttgagcctgggaggccaaggctgcagtgagccatgattgtgctatggcactcctgcctggacaacagagtgagaccctgtctcaaacaaaataaaacaaaacaaaacaaaacaaaaaacttgcaacttgctcttggcatatccattgtgtggatatactacattttgtttatctatttgtcatttggacatttgggtagtttctactttttattttattttttgatggactctcactttgttgccaggctggagtgcagtggcgtgatctcggctcactgcaacctccgactccctggttcaagtgattctccttcctcagcctcccaagtagctggcattagagacacgtgccaccacacccagctaagtttttttttttttttttttttttttttttttttttagtagagacagggtttcaccatgttggccaggatggtatccatctcctgacctcataatccacctgcctcagcctcccaaagttttgggattacaggcatgagccactgcacccagccagtttctactttttggctattataaataacatggctatgagtattcatgttccagtttttgtgtggacatatattttcatgtcttttgggtgtgtatctaggagtgggattgctgggtcatatggtaactccgtgtttaacattttgaggaactactggattgtttttcaaagtggctgatccattttacattcccaccagcagtatatgaggcttccagtttctccacatctttgccaacacttgttagtatctgtccttttgattatagccatactagggactgtgatttcacttgcttttttatttaatgtgtatggatttttttctgtatcagtatatatagatagcttgtgtgtgtgtgtgtatgtgtgtgtgtgtgtgacagtctcactctgtagcccaggctgaaatgcagtggcacgatctcagctcactgcaacctccgcctcccaggttcaagcgattctcgtgcctcagcctcctgagtagctgggattacaggctcctgccaccacgcctggctgatttttgtatttttagtagagacggggttttgccatgttggccaggctggtctcaaactcctgacctcaggtgatctgcccacctgggcctcccaaagtgctgggattgcagacgtgagccaccacgcccagctgatatcttacatatttaactgctgcataatattccacagaaaccatgcttttcaagatattcctgcctatatcattgtgttatttcttccaccagggcgcagcagtctggaaatagaaacaatggtggtggatcaattcaattgatccagatttggaagttgcgtggcaagtgagaaggatttggatggtaatggtgagaaaggatttgaaataatttatcaaacctggttcagatcaatcctggtgcataagtgactaacaaggagctggagtggatggcatagcatagtggctagaaccctaaaacaagggattttacatgaaagtggaaaggtaactgtttggttttgcatttacccattccctctgttgagttttttttttttaatactgagttattcactactttgtcttctttttttttgagacagagtctcattctgttgctcaggctagagtacagtggcaatctcggctcactgcagtctctacctcctgggttccagtgattcttgttcctcaaccttctgagtagctgggattacagatgcccactaccatgcccagctaatttttgtgtttttattagagatggggtttcaccatgttgaccaggctgatctcgaactcctgacctcaagtaacccacccacctcagcctcccaaagtgctgggattacaggcgtaagccactgcacctggcctgctttgccttcttaaacagatgattcagaacataatataaccttgtcttgtgactcagggtggccattatgatcatctgcttttgacctggacctctgaggcatgtagcaatatgtctttccttatgtcttttccctaagtgtgttccggatttttgtgcttttgaagaagttctgagatcaacgtattcttggttcttctaatgtgtagctgtttgactaaggactgactccatgcatctcctatgaagtgaagttcatgggttttatgacagcaattttacatgctgcttagatgcttttttctcatctaggtttttagttatattatggcagagattataagaaatctgatctctagagaagtgctggtacttctttaatttggcatagactatttttggcaagctagttttctagcattgaacactttaatgaataagttcatagtcaccctatccacattctttttaatggtagaaaactgtctgtctaatacagtagccattagctacatgtagatttttaaatttaaatatacattaattaagagtaggctgggcatggtggttcatgcctgtaatcccagcacttcagaaggccaaagtgggtggatcatttgaggtcaggagttcaagaccagcctggccaacatggtgaaaccccgtttccactaaaaatacaaaaattagctgggcgtggtggtacacacctgtaatcccagctactcgggaggctgaggcaggagaattccttgaacccaggaggcagaggtttgcagtagccgaaatccgccactgcacttcaacctgggtgacagagcaagactccatctcaaaaaaaaaaaaagaaagaaaaaattcccttattgtactagccacatttcaagtgcttagtagtcacatgtggctactggctaccctattggaaagtgcagatgtagaacactttcatcatcaaataaagttctatagagcagcaatggtttagacattgagccagtctcttctcaggcttcttgtttccaaactagagtctcatggtttaagtgcatccttgtacaagcaaccatgctcatactattctccaacactctctgatttccaacccctgatcattgtcatttgctctctattagtattaatttcctatggctactataacaaatcatcacaagtttagtggcttaaaacaacataaatttattatcacatatgacatagttttgatatttgtccccttcaaatctcatgttgaaatgtgacccctaatgttggaggtggagcccactgggaggtgtttaggttatgggggttgatccctcttgaatagcttggtgctgtccccatgataatgaatgagttctcactctattagtttacaggagatctagttgtttacaagtacatagcatgcctcccctctctctatcactcccccctcaccatgtgacatgcctgctcaccctttgccatctgccatgattagaagcttcctgaggttctcaccagaagcagatgctggcatcatgctgcttgctgcttatacagcctgcagaactgtgaggcaaatcaacctcttttatttataaattacccagtctcaggtgttcctttatagccacacaaaaccaactaaggcaatacagttttggagattgaagttcaaaatcagccattttccagcttctagatgctgcctacattccttagttcatagctccttcctccgtcttcaaagcctgcagcgtagcatcttcaagtctctctgtgactctctgacctccgcctccatagtcacgtgaccttctctgactctgaccttcctgcctcttttatgaagagtccgtaataaagattaggtcgccttggctaatccagagcaatcatctcatttcaagaatattaacttaatcacacctgcaaagtccctttcagcattttaccattatgttataccggtatgttgtgaggaccactattcagcctgccacagacagttttctacagtggcattttgttttcctgtgatggacagtgatccagtggtccttattttccaggaccagagtatgctggtccagcacagagtatgctgatatcccaaggttttatataaagggaggataatgttttaaaatcttattttctgtgagaaaacattttaaatggtccattttcaaggtatgataaatctaagtactggcagccagcctgcggacgtgacaaaccgcacagctcatgcacctagaaagtcgcaataagcaaacagaatgtagaggaggagtcagcctataaaagggaagaaaaagtttacagagttattggaaaatcgaaacttaagcagggaaggggactgggttataaccttataagggataatgaaacttaggtgacgtccagaaagattgtaaccccacagtatttgaccaatgaggaactgggggagggacttgcgtgctaggagataaattacctgctgtagctgccccagctgtgcctgcctaccagacacccattcttgcacgatcaccattaaaattctctcttccattgttcttttgtgtctctgagtccattctttgggtttggacagatgaatgtgtttctcacaaacttgggggcccatctgggatctctgtgcctgcgtggagttggactccagccaagaggggagaggcgtcccacctgatttaagtggcctgctctgtctgggaatcccggctccctgcagaggccatagacaaacctgagactgttattcaggaggcagtggaggtgacacagggagaaaagcaggcaccgtggcaaccaggcaacctcatgtacgagccaaggtaggaaaattggactgtgagtattgtcttggtggttgggcatttttggaggtcgagtgtgtgtgactgagacgtatcctaggtatgaagcaagtgtggagacccaatttgcggttctgttctctcgcgaggggaacagccagagacggatgaaatgattctcggtgtgtgcaagaaacctctagtggggggcttgagtacacagggaaaaactcagacacagattgacgaaaatgggaaacagaaattctaggcctaggggacaaaggaaagagggagccaaagagactccctctgacattcccccggatagtcctttaaggagaatgctgcaggtttggagggacaacccttgaaccagggacaaggaaaaggaaaagatgataaagtattgctgttttacctgtcccaaagaccccattcgcaagccttcagtcttttgatttaagtttggctcagatgagaactgggtgtgccaagctttaattctctatgtgaatgataaaaccccattctaggccgggcacggtggcttacgcctgtggtcccagcactttgggaggccgaggtgggtggatcacgatgtcaggagatcgagaccatcctggctaacacaatgaaaccccatctctactaaaaatacaaaaaattagccaggtgtggtggtgggcgcctgtagtcccagctacttgggaggctgaggcaggagaatggcgtgaacccgggaggcggagcttgcagtgagctgagatcgcaccactgcactccagcctgggcgacagagcaagactccactaaaacaaaacaaaacaaaataaaacaaaacaaaaaacaaaaaccatcctcacaagaagagataggttatgctctctgctggatcaaagaattaacccccacgttccccatcaaagaagaagaaaaagagcctagtaaaaagctcttgcccagtgaaaagccctgggaccccctatcatgcttgcccctccatacagctcacaaaataggggacaggaagatcaagggggcaacaggagggttagaggaagaaagacctggagaccatgggggaaccaaaccaattgctcctttaagtcctcatccaaatttaagaaaaagaacagtgtaagagggatattaagaacttccttatcctgtccacacagcaggcatctagcatgctccctcttagagaagttcccatgggacagggagagactggctttgtaaatgctcctcttacaagttctgaagttaggaatttcaagaaggaaatgaaaccacgcctagaagatcccctcggtttagcagaccagctggaccaattcctaggaaccagcttttacacctgggctgaaatgatgtctatcatgaatattctgttcacaggagaagaaaggggaatgattaggagagcagccatgaccatctgggagaggcaacaccctcccaggcaaggagtcttgccaaccaaacaaaaatttccaaatgtcgatcctaaatgggataataatgatcccagggactggacccaaatgcaggacctcagggaactaataattaaagggatcaaagagtccactcctaggacacaaaatgtctcaaaggcattcaagattcaacaagaaaatgaggaaactccctctgcattcctgcagaggttcctgagaaaatactctagattagatctggaggacccagtagggcaaggccttttgaaggttaactttgtaactaagagctggcctgacattacaaaaaaattacaaaagagtaatgaatggaatgagaaaccagttgaagaattactgagggaagctcagaaggtctttgtaaggagagaggaagagaagcagaaacaaaaagcgagaatcatggtttccactgtggaaaaggtagtcagaagaaggttagatcaagatccctcttgaaggaaacaatgggataatagattttgacacagaggaagaagggaaaagctcctaagactatgagttgatgttacaagtgcggaaaaccagggcattttaagagagaatgtcctgaatggaaaaaagaagaaaaaatgatccccttcatgacggttgatgaagacaaggggggccaggggttccttctgagtaggaccctccaggaaccgctgataaatgtgaaggtgggacccgagggagaagaagtgacagttttggttgatactggggtggcttgctcctccctaattcaccaaccaaggggtacagaagtctctaagaaaaaattgacagtatcggggtaaaaggggagggatttcaggttctgatattcaaggaaatgttaattagattgggacctgaacaaattgaggtgtgactcttatatgttcctgaagcaggaactaacctccttggtcaagacctgattgtgagattgggtttaggattaggaatagaggaaggacaaataaaagtaatgatgggcctcctaacaaagcaagaggaaagaaaaattaatccccttgtgtggattagggaaggcaacaggggagggttaaaaatcacacccttacagattaaactaaaacaaccaggagaagtagttttcagaaaacaggccaggcacagtggctcacgcctgtaatcccagcattttgggagac[134 bp omitted]gaggcaggagaatcacttgaacctaggaggcggaggttgcagtgagctgagatcatgtcactgcacttcagcctggcaacagagtgagactccgtttcaaaaaaaaaaaaagaaagaaaaaagaaagaaaaagaaaacaatatcccatttctactgaagggagaaaagatctccaactggtaatagagggattgattaaagatggactattagaaccctgcatgtcactatacaatactccaattttcccagtcaaaaagcctgatgggttctatagattggtgcaagatctagggactatgaatcaaattgtccagacccaccatcctgtggcacctaacccctacgccctccttaataagatactctatgaacataagtgattcagtgtggtgggtctaaaagatgtattctgggcatgtcccctagatcttaggagcagggacctctttgtctttgaataagaaaatcctataactgggagaaaacaacaggactgctagactgtgctgccacaaggtttcatggcagccccaaatgtatttggtcaaataatagaaaaagtccgggaggaattccaaccttccaggggaacccagtcattacaatatgtagataatcttttaatttctggggagaggagggccgaggtatcagaaaccaccataagcttgcttaatttcctaggagaaaggggattgcaagtctctaagaacaaattgcagtttgtagaaaaagaagttaaatatttaggacacctgattagtgaagggaagtggagaataaacccagagagaatatctggaatagtgggcctgcctttgcctaagacagagagaactccgaaaatttttaggttcaactggctactgcaggttgtgaattgactcatatgctcaaaagacaaaaattctgtatctcaagttactagaagaggaacccgatcccatgcaatgatccccataggaaattcaggtagtgaaagagctaaagcaggccctcattactgccccggtcctggccctcccatctttagagaaaccattccatctgtttgtaacagtagaccagagtttggccttggagtgctcactcataccgggggagggaagaggcaacctgttgcttttgtctccaagcttcttgagcctgtctctcgggggtggcctgaatgtgtgcaagcagtagctgccacagccctgctggtagagtcaaaagctaactttggtggggccctaatagtaagcacccacaccaagtcaggaatatattaaatcaaaaagccaggaggtggttaatggattcttggattcaaaaatatgaagccatgtcactagaaaaagataatttggctgtaacaacagatacttgcctgaatccagccagtttcctatggaaaggagagaagaacaaagagacatcagaccataactgcttagatatcatagaataccaaatcaaagttagaccagaccttaaggaagctccactacatgatgggataaggctgtttgtggatgagttttcccaagtgacaaatggcaagagacataatggttatgctgttattggtggaaatagttaaccaagtaatgaccctaaaagggtagaaataattgaggtaaaggatttaaggcaaactttagaaattgagacagggtacagggatgtgaatgcctggttcaaattttcagtacaagccctcaacaagagtaattgctggctgggc[137 bp omitted]gtggcacgtgcctgtaatcatagctactcgtgaggatgaggctgaggctgaggcaggagaatcgcttgaacccgggaggcggagtttacagtgagccgagatcatgccaccgcactccagcctgggtgacagagcgagagtccgtctcaaaaaagaaagtaattgctatgtgcgtgctgcgggacgacctcaggcccaggtgattccatttcccctaggatgggataccgatcctgaaggcatgcattgcatgttggctctataccaggacaaagatgcatgggaaatgagacttgtaagagcctgtcattgttctttcctgcattgtggtggtcagatcccagagcaatcccctcattctctatagggaatatgaaccactcctcttgtctctctaggcagggggcagagttcaataagcccgtgggagaactctcgtacttgtacccacatcctaattgtcactgctgagtcaggcaatggcaattactcagctctccatatactctgggctgttgtctggtggtattgtgggaaaggggacctccataacctgttagttactgtccaactggaccaggacttgtgctttagtccaattggccattcctttcaccctggcattccataagatacccgaaaatacacatggccaccaaaaccagacagatttgacaaattcttttgatcccaatatatatattgactcgacaggagtccccaagggggtgcctaatgaatttaaggcctgaagccaaatagctgctgggtttgagtcagcactcttttggtgatcaattattaataagaatgtggattggattaactatatctgttataatcaacagagattcatcaattgtactcaggacgccctcaaagaggtggctagcgagtttgatgccaccagccaaatggcctgggaaacagacttgtgctagacatgatactagcagaaaaagggggtgtatgtgttatgctagatgggaaatgttgtactttcattcccaacaatattgccccagatgggaccatcaccaaagttttacaaggactgacaactgtagccaataaactggcagaaaatgctggaattgacccatttacagactggctagaaggttggtttggaaaatggaaagacatggtagcttcaatccttacatctctcataattgtggcaggagtcttaacagcagtgggatgttgtattatcccttgtgtgaagggagtagcacagagattaattgaaacagctattaataaacaaatgccaatgacttaccagcaaaataacctgctactattagaaaccaaattaaactcactctcctataaggaagaaagtagacaacttctagagtgattggaggaccaaaagggtttagatgaaaatgagaccaaaggaagtaaataaaaaagaggagggaatttgtgagaaaacattttacatggtcaattttcaaggcatgataaatctatgtactggcaaccagcctgtggacatgacaaaccacatggctcatgtacctagaaagtcatgataaggaaacagaatgtagagcaggggtcagcccataaaagggaagaaagttttgttattgggaaatcgaaatgtaagtggggtaggggactggggtataatcttataaaagataatgaaacttaggtgatatctgggactattgtaaccccatagtacttgaccaatgaggaactgggggagggacttgcatgcaagagataaattacctgctgtaactgccccaggtgtgcctgcctaccagacacccgattttgtaagaccgccattaaaagtctcgcttccactgttcttcgtgtctctgagtctattctttgggtttggacgggtgaatgtgtttctcacattttctgcctttcgcctatatggaaataccaaaatatgattgttctgaccttcaaaatatgattctgtgagtatagtggtataggagtatcttatcagcaagacaaatccacagctaactcaatatcctatcagagtgtttggctactgtaatacagttatttcagggctaatctctgccaacttttcttctcaaacacacacacacacacacacacacacacacacacacacacacacacatagggatatggatgcacccataaacaaaaaactgggggctcgatatattaaccaaagcaaagccttctgagcttctctttgccccccaaaaaaggatgataaatgaaagtctgaatcattcctaggagaagaagcagcagacaccaatgcaggattggtcttccacttccagtctggacaagatagcatagactcatttctccctgcttctcccaggtaagcccaaccagaaatcctggaaataattcaagaggtggccacaggagaattctaaaaggtgtaaaggggaaggcagaacgattaggaatcccaggactggaggaacaccatagtagcagggtaccttatgactctcaagccataaatgtgacccaggcccagcatttcccaaaccccaacgtagcaatagaaaatggttcctgtaggttcctttctcctctgcattgaatgggagtcctactgacaccaacaggtaagcctggcaactccagcaagtgggatttagcaaggtgcctcactgacaataagcagccagcagaagtgctgtcctttcccacaaggtcagagactcccctaccccactgaaagatactctccaagcaagcacaccatcaaggggaaacgtgaccatgacaagtagcctagcccaggaagcctgtttgttttcatggtcttgaggcttctctcttcctctgagagataccaggaaggcaggcagcaaagtcaggggagtcccaccagaaccagcagagacaaggaagattctttgtttccacagactagaaaaatcacttcccccacctagaggcaccaggcaaccctatctgaggaacactctgcttcctcaggcagcaccagcagggaagagtggacccattagcaccacatgaatcaagcagatcaaaatagcactacagaggctctgaaactaaattgtcattggaatcacagccttcaaaagtaggccaggacctgcatgctaaacctaaacaaactgactgcctgctaaaatcaaatatttaagtaggaattagagtcttctaatataatagtcaacatatccagaatatgataaaaatcaccctaaaacaatcaactgataccaacaccaagatgaattagatgttgaaattatctgacaagggatttaatgtagccaccacaaaaatgctttaataagtaattgcaaagtctcttgaaataaatggaaaaaatataaaatcttagcatagcaatagaagttatacaaaagaatcaaatatactccaggccagtctgacatggtacattcagtctctgattaagaacgtggagtagggcaaggacaagttaagatgggaaatacatgtgtggttctgtgatggagctgcagctgaattatttcatcacaaggggctcttatgttatcaaaggacacagacctgaaccttgactgagtagttttctgaggggcattgagcacttcctggggagtccagaattgggaaacttggttttgaccttcatgtggctgtgtgactatctcttatctgcctctttctgggaataggaactacttcaaatccaggaagggaggctggtcaaatacaaataacaataaacagcccaatggcaacccttccttgcagtgagtacttactgtgtgccaaacactgaactagatctctttgtgatcatccattcatggaatcctcacagcagccctccactaagggcatttttgagatctcaggtttaattgggttaaagttccctcagtagacacctggggtatctaccagcctacaaggacctgtgccgggtacaggtataggtgatactgtgatgacacccttcatagacacatgtgactagagctcacagcaggtgggggcaagcaagttcctgggatagaacaacatgggggtcccaaggaacaagtggccacattctgggagtgtttgggaagatttccccttggcagggtatttaacttgggcctccagataccagtgaaagcatgggctttggcatcaggaagacttggattcaagtcctgactcctttgcttcttggcaatgggaccttggttaaataacttaacctaaaaaaaaaaatttaacctgactgagcctcagtttcctcatctgtaaaatgggtataagtattgctataatcattgttgggttgttgtgaggaagaaatgggaagatgctcagagcagccctaggcagggatagtctgtgcctctttacttgaaggccccttctgacacaccttcttccaggaatcctttgatctcttcttccttcaaattcatacataatcaggcattttatacatgattaaaacacctgttcacattttctaaagaaccaaatgaaaattacagaactgaaaaatagatttttaaaaattgctggataggatcaattatagagcagagatggcagaggacaaaatcagtaaacttgtttatagatcaatagaatttacccagcctgaacaacagagagaaaatagactgaaaaaaaagatagggcctcagggacctgttagaaataacaaaagatccaacattcatataatcagattcccagaaggataccaaaaccaaagacagtacaaagcaagaaaactatagatgaatgaatatctttcatggacttagacacagaaactgccgcaaaataatagccaaatgaacccaacaatgtagaaaagaattatactctgggatttattcccatgtatgcatagttcaatattttaaagttaatcaatgtaatccaccatatcagcagactaaaatcatttaaccatatcaactggcacagaaaaagcatttgatgataacattcaaacttttttttttttttgagacagggtctcgctttgttacgcaggctggagtgcagtggcacaaacatggttcactgcagcctcaacctcctgggcccaagtgatcctccctcctcagtcccccagtagctggtactgtaggtgtgtgccatcatgcctggctaattttttgtatttttttgtagagacaaggttccactgtgttgtccaggtttgtctcgaactcctgagctcaggcaatctgcccacctcagcctcccaaaattgctgggattacaggcatgagccaccacacccagcttaaagttcaacatttattcatgattaaaaactctcagtacactaggcatagaggaaaacttccttaatctcataaagaacatctgcaaaaaacctacaactaacattatacttaatggtgaaagactgagttctttctcaagtcagaacaaggcaagcatgtttgtttccactatttttttttttttcaggtggagtctcactctgttgcccaggctggagtgcagtggcacgatctcagctcactgcaacctctgcctcctgggttcaagtgattcttgtgcctcagcctcccaagtagctgggactacaggggcccaccaccacgtgcagctaatttttgtatttttagtagagacggggtttcgccatgttggccaggctggtctcaaacttgtgacctcaggttatccacccaccttggcctcccagagtgctacagtcatgaacaaccgtgcctggctgttctcactacttctattcaatatcgtattgtaagttctatccagtacaatggcaagaaagggggaaaaatagctctagcacaacaagaaaaggaaataaaaggtacatggattggaaaggatcaagtgaaactgtgttgattctcaaaagacttaattgtctacatagaaaatcacagggaatcttttttttttaaaaaaaataaaacaaaaaaacctcgtagaactattcactgaattcagtaaggtcatatgataccagataaacacacaaaaatcaatcacatatatatactaacaatgtggaaatctaaataaagaacacaatgccattcatccttgtgccaaagagcaagtataaatttaacaaaacatgaaaggatctgtatgttggaaattataaaacactgaggaaagaactcaaagaagaccttaataattgcagagacatactgtgtgggttaaaagacaacatagtaaagatatcaattatccccaaattgatctataggctaatgaaattcctatcaaaatctcagcaaggatctttatagacatagaaaagcttcttctaaaatttacatggaaaggcaaaggacctagagtagctaaagtgatttttataaagaataaattggagggaatcactcttcccaatataaagggttaccatatatggctatagtaatcaagatactgtggtacacggatatagacagtggaaatgatagatcattgcagacttggaagagtgaggggtggaagggaggaggatgatgagaaattggctaatgggtacaatatatgttattcatgtgatggatacactcaaagccctaactaacttggcctctgtgcaatctatgcatatgataaaattgcacatgtaccccaatattgtacaaataaaaagaaaaaaaagagagtatggtaatgacagagagtagacacatagatcagtggaacaaaaaacccagaaatatagcaatgcaaacttgctcaaacgatttttgacaaaggtataaaagcaacttaaggaaggatagcgttttcaacaaacagttcaggagaattgacatccataggccaaaaaagtgaacttttacctaaacatcccaccttatacaaaaataactcaaaatggatcacagacttaaatgtaaagcatacaactataaaacattttagagaaaaaacaaaaccacaggagaaaatcttcatgatttagggcctagcaaagtgttcttaggtttgacactgtctaggggttatccatgtaagaaaaactacattaaattgggcttcataaaaaattaaaagctttgatctatgaaaggtcctattaagagaatgaaaagacaagctatagactgagagaaaatatttgcaagctacataccc[137 bp omitted]atggcaagaccacctctctacaaaaaaaaaatatataaaaattagctgggtgtggtggcgcgtgcctgtagtcccagctactcgggagactgaggcaggagaattgcttgagcccaggaggtcgaggcaggaggtaccaccacactccagcctgggagatagagcaaaaccctgcctctggggtggggatagattaacacaccctattttgatttcctagtgctgtctcctggtatgaagatttatatagcaaaggcttggttttttcattaaagtgatgttcaattaaacttggttactgagaatttccagaaggcaaacaattcttctttggattaccagaggccctaaggtgctacatactcaggtttgggaagtcattcttctttgtaactatccagcctggtagccagatggccaatgagtttcatgcctgcacaatgagccagaaaatgttcaaggccccaatttttttgtttttatctttttttaaaaaattaaactttctattttgagatgactgtaggttcacatgcaattgtcagaaacggcacattgagatattatgtaccctttatccagtttttctcagtggtgacatcttatttactgtactatagtatcacaaccaggacgttgctacaacctattactcttgtccagatttcccaagttttacctgtaatcatttgtttctgtttatgtgttctatgtatttcattatatgcattttaaaaaaaaataacagatctttttcactagaagttttatgcagttgtagcacttgtagttcatgtatccaccaacacagtacagaaacgtactttcaccacaaggaatcttttgtagccatgcctatctctttttttttttttttttttgagatggagtttcaaccttgtcatccgggcttgagtgcagtggtgcaatcttggctaactgcaacctctgcctcccaggttcaagcaattctcctgcctcagcctcctgagtagctgggattacaggcacctgccaccaagaccagctaatttttgtatttttagtagagacagggttt[132 bp omitted]ctaatgcctggtacccactaatctgttccctatctctatatttttgtcaagagtgttatgtaaataatcatacagtttataaccttttaagattggctttttttcactaagcaaaattcccaggagttcattcaagttattgcatgaaccaatacctgatttcttttttttttcttttttgagacagtctcattctgtcacccaagctggagtgcagtgatgtgatcacggctcactgcagctttgaactcactcaagcgatcctcctacctcagccttctgattagctgggactacaagcatgtgctaccacacccagctaatttttaatttttttgtagagacagtgtctcactatgttgcccaggctgatcttgaacccctgggctcaagcaatcctccttcctcagcctcccaaagtgcttggattataagcttgagccactgtgtctggcccctgatttcttgttattgctgcatagtattccatggcatggatgaattataatttgtttaatcattaatctgttgaagaatgccaacaatgtatgaatgatacagtttttctgcttatttgccagcatgtgtgttgttaactgttttttaattttagctattctgataggtgtttagtgatatctcattgtgattttaatttgcatttcccttatggctaatgatgttgattgagcatctttgtcgtgtgtttgcaatctatatatcctttttggtgaaatatctattcatatattttgctcattttctaatcggattgtttgagttttgagaggcttttttttgggacggggtcaattttgtattgctataaagaaatacctgaggctgggtaatttacaagaaaagagatttaattggcttatggttctgcaggctgtacaggaagcatagtggcatctacttctggggaggcctcaggaagcttccaatcatgttggaaggcaaagcaggagccggcacatcacatggtgagaatggggtggccagggcagagagagggaagtgtgtatgtgtgtggagagacagagagagagagaagagagcgccaccacacacttttaaatgaccagatctcatgtgaactcagagtgagagcccacttatcaccaagggggtggcccaagccattcacgagggatctgtccccatgatccaaacacctcccaccaggccccacctctaacactggggattagatttcaacatgagatttgggtgaggacaaatatacaaactctatcagttatactgcatagttgatgaagtctgggcttttagtgtacccatcacccgaattgtatacattgtatccaataggtactttctcatccttcaccaacctcccaccctcctaccttttggagtcttctccaatgtgtattattccaccctcattatagagttttgaaaccagaaatcagcatcttgggctgcctgaactattcttagatcacttctctcaccaattggggaaacttacaggacagaagaagccagctgacttctgtacatgtatatggttcttgcccaggagcctccatgtgattctagagccagtcctacacacacacacacacacacacacacacacacacacacacaataggtacaactgcctcaggaagtcatgttttaaggaattcttaaactgccctcctgagtacccccaaatgtctcttgctaaagtttaatcatgtctgaactttccagcatcagaatcatctgtctggactgaggaattccagaagacctccctaaaaatgcagatgcgtcacttatgaggatattccatgatgaagttcggccctgtgggattagaatgataccttttgatttgagatgtgtgagaggtctgaaatggtgctcaatgctaagaaataggaactccagcttacattaagaggtgggacagggaatgaccctgcccagccaggtgtcagcaggagatgctgggactcagagaggtgggccagaaggggaggaaagagccaaaggaggagtgggggcatgctgagtacaaactttgcctatttcataaatatgcctggatcatgccctggtgggccccactattgagttgggtagctagatgcttgttggcttctgccttatctacctaccagaaaaacactaagtaaaagctttgaaattcaattcaataaaaaagagtttatgaatccagtgtacttagccaaaatgagggataaggatgacttctggttgcaggagggctttattctttgtttagtttcctcttcttttgtgcttcccctttctcctcaaaggcaagccatcacggaggtcctaaggaactcaattgtcaagtattgaacactgccagtttctataaggaagggagtcagtctgaggtaggaggatttaacctggagctgaaggcaataggacaatctttgcacactgcatccagaagtaagcatcccttctggcccgacacggtggctcatgcctgtaatcccagcactttggggggccgaggcgggcagatcacttgaggtcaggcgttcgagaccagcctggctaacatggcgaaaccttgtctctaggaaaaatacaaaaattacccgggcatggtggtgtgcacctgtaatgaggcgcttgaacccaggaggcagaggttgcagtgagctgagattgtgccactgcactccagcctgggcaacagtgcgagaatacgtcttaaaaaaaaaaagtaagcttcccttctgcctggggttaaccagggccatggtctttttcacctttttttttttttttttttttttttaagacaagtcttgctcttgtcgcccaggctggagtgcagtggcacaatctcggctcactgcaacctctgcctcctgggtccaagcaattttcctgcctc[134 bp omitted]cggcctcccaaagtgttgggattacaggtgtgagccaccacacccatcaccagtgttattttatagctcccctcccaactacagacatatacaactaatgaagtaagggtgtgtatgtccagcaacacagctaatttctgtcaattggccaatgctcaacaattgacaaattagtagactgtgcttgagttgacacttttacaatccagtgcttcataaaacagatggctgcttgttttattcatatataagtggctcttagtgcatcaaaaggatgtttaaaacaacaaaagaacaatcaaaagcacaatttgtcacctcgattcttaacagattcaagccgtataatgatacgagcctttggttaaacaagcaaaatgacagattgccagcagaggtattgaggcaggcacagtcccattcctgatgggttctggccatgacacctgtacaccaagcaggtgtgtttacgtgtgccccaggaagtgggagatctgagcattaggatattccagacctcttcacattagtagtcataaaggaagtgcaatttgaggaagagcagaaataaaatacactcaggaagctagtaaggcattctgagacccaaatgagaacgggaaagaaatgcatctttagtgctgatgcagtcaggagcctttcatgttgagcctttcacaaatgaggtgtgaacattttcaactgaggtaacaacctctcctccatttttgttgatctaattttccatttcagttgctccttctctgtacccagccccactgtgggactgcacgctaattatctcatggtggttataccatctgctgaaaaagctggcagctgggcaatcaccgtcttccaaaattgtggcctccctctacctgccctggtacaaaaaacagaaggcagtgtgttgacccctgtaccctgctccagggactgcatcagcttcacagattggaacagaaacctagaacttaacccgttctccaagctggagcctcctgtggggttccgtactgaggttttgggactcagcctatgtctacacattgcctaggtggtggacccgatgacacggtcaatatggtgaaagtaattgagaagagtaccagacgtgtggtttgtgatccaaggtctgaggtaaaggaactagttaatttcttggccactgcttttacctctatcagtagccacctgggtacacatgatagctgtttggtcacaagagtgtgagagagtatggatgattcagaataatctcatcctcaatgctagcaaaagaactgaaaggacatggcttattcatagatcagttgtaccatcttttcatagaaaggacagcacaggctgagcatagtggttcacggctataatcccagaactctgggaggctaaggcaggaggattgcctgatgccaggagttcaagaccagccttggcaatatagcagttgccatttattaaaaaatgattaaaaatagcgaggtgtatggccaggcacggtggctaacacttgtaatcccagcactttgggaggctgagacgggcagatcatctgaagtcaggatttcaagaccagcctggccaaagtggcgaaaccctgtctctactaaaaatacaaaaattatctgggtgtggtggtccacacctataatcccagctactcgggaggctgaggcagcagaatcacttgaacctgggaggtggagtttgcagttggccgagatcacgccattgcactccagcctagcgacacagtgagactccatctaaaaaaaaaaaaaaaaaaaaaaaaaagtcagatatggtgatgcatacctgtgtcccaactacttgggaggctgaagcaggaggatccgttgcgcccaggagtttgaggttgcagtgagctgagatcatgcctttgcactccagcctgggtggcaaagcaagactctatctcaaaaaaagaaacaataaaaaagaaaggcgacgtgatctttattcacaccccctctctaaaagtattcttaaacttcagaatagaagcaaggaacttaggtgttacactggaaaatcattccaagctggcagtaaggaagaaggtgagcagggcacactgtctctagactaatttccctccaaaaagctttgaaggtttggtaagaatagttgatgagttgagaacagtagttatacaccctttcttttacatatatcaaaacattctaggctgggcacggtggcagtggctcagagctgtaatcccagtactttgggaagccaaggtgggcagatcacctgagctcaggagcttgagaccagtctggggggc[143 bp omitted]aaaccccatctctactaaaaatacaaaaattagccaggtgtggtggcacgcgcctgtaatctcatctactcaggaggttgaggcagaatcatttgaatctgggaggtgaaggttgcagtgagccaaggttgcaccactgcactccagcctgggcgacagagcaagactccgtctcaaaaaaaaaaaaaaaaattagccatgtgtggtggtgcacatctgtagtcccagctacttgggaggctgaagcaggagaatcacttgggcctagaggctgagacaggagaatcacttgggcctgggatgcggaggttgcagtgagccgagatcatgccactgtactccagtttgagcagcagagcaagaccttgtctcaaaaaaaaaaaatctcttaacattttatgacaactgtgagagaggtaatgaagagagaacaatattcactatctcctcaaaaattagcagggttgaggagtaaaccttgattttatcaggaaaaaaagtggtttgtttccctcttttgagccattgatttgctctcaaggggacacacccttactgttgtacagctgagcactgatattaatagcaagaggtcaatcacattttcccctataactctcacttccttttacttaccatattttgtgactgggtttttggggttttcttctattgtcatgaccttgaaaagaatatagtcagcttctacccatttgtattaatgtaggagagcagtgatacagctacaagaaaagtgtagataaaccaaatgtcaaagaatcataggctgctccaatttctatggctggaagagccatagaaataacagaagccagttcatcacttttatgtttggagaaatagaaacccagagagagaaggtggcaaatctcatgactcctgttcctgttctctttccagaatatgatatatgactttattgccacacactttcctttctaattatgatttgtaaaggttatcagttggcattcctgggacatgtagccaatttggtgttaaaaaaatagatccagagccatacaaatggtagggaaatgtaggcccaaattaaacattaatcctgaacaatcagatccagagtcgactctagctttcattgttaagtgctggctttctcctaggttctgtccttggccctcttttcttctatttagagtagctctacatccagggttggtctatctggcaaacgtaagactaagtctgaattagcccctcctgccccctggcaacttccatcatattctttgcctttataaatttatgaatttgattatcttctattccaaagaggagtgagatcatgcagcttctctcttctgtgtcttgtttatttcacttagtataatgtttccagctccatccatgttgtcgaaaatggcagaatttccttcttcttctttttcctcttcctccccttccccttccccttcttcttcttctccttcttcttcttcttcttcttcttcttcttcttcctcttcctcttcctcttcctcttcttcttcttcctcttcctcttcctcttcttcttcttcttcttcttctcctcctcctcctcctcctcctcctcctcctcctcctcctcctcctcctcctcctccttcttcttcttcttcttcttcttcttcttcttcttcttcttcttcttcttcttcttcttcttcttcttcttctccctcttctccttcttcttcttcgacagtgtctcgctctgcagcctcagtctcctgggctcaagtgatcctcctgcctcagcctcccgagtagctgggactataggtgtgtaccaccacacctggctaattttttgattttttatagacacaaggtctcattatgttgcccaggctgatctcaaactcctgagctcaagcagtactcctagctcagcctcccaaagtgccggattgcaggtgtgagccactgcacccagcctttccttcttttttgaggttgaataatattccattatatatctatacaccacattttctttatccattcattctgccactgcacccagcctttccttcttttttgaggctgaataatattccattatatatctatgcaccacagtttctttatccattcattcatcaaaggacatttaggttttttctacaccttggctactgtgaataatgcggcagtgaacatggaaatgtagctatctcgtcaagatgctgatttcatttcctttgggtgtatacccagaagcaggattgctggatcatatggtagttttgtttttaattttttgaggaaccttcatactattttccataatgactgtactaatatacatttttgccagcagtgtacaagagttctcttttttccacatcctcaccaacacataacttttctctttttgatagtagccattcgttctaacaggtgtgaggtgacatctcattgtggttttgattttcctttccctgattagagatattgagaatcatttaatatacctattagcaattttaatttcttttcttgagaagtgtctatttaggtcctttgcccactttttaattggcttatttgtgtttttggcattgagctatacaggttccttatatattttgggtattaatcccttattggatatatagtttgcaaatattttctcccattctgtatgttgcctttgcattttgttgattgtttcctttgctgtgcagaagatttttagtttgatgaagactcgcttgtctatttttcttttgttgcctgtgcttttgctgtcatatcaaaaagtcattgccaagaccaatgtcaaaaaggcttttctctgttttcttctagagttttgtggtttcagatcttatgtttaagcaatccattttgagttgatttggtatatggtgtgagctaggggtcttagtctttttctgatgctgtaacagaataccaaagattggataatttataaacaatagtttatttgactcatggtctggaagctgggaagtcaaagagcatggcacctgcatctggcaatggccctcgtgctctattatctcatggcagaagggcaagacagaaaataaggggactgaactcccacaataactacatactccattgatagcagcattaatcaatccatgaagttgaagcccttatgtcctaatcatctcttaagatcccacttcttaatactctgacaatggcaattaaatttcaacatgagttttggagggaacattcaaattatagcagggtccaatttcattcttctgcatgtgaatatccagtttccccaacaccgtttgttgaagagactgtcttttcctcattgtgtattcttggcacccttgttgaagatccgttaaccataaatgaatgggtttatttctgggccctctattctgttccattggtctatatgtctgtttttctgtcattactatactgttttgattgctatagctgtgtaatataatttgaagtcagggagtatgatgcttctagcttcttgtatgattgctttggctatttggtgtcctatacgaattttaggattccttttcctatttctgtaaaaaataattgggattttggtagggattgcattgaatctgtagattgctttggctagtatggacattttaacaatattaattctgccagtctgtgaacaggggatgtctttccatttgtttgtgtgttttaaaatttcctccatcaatgttttataatttctagtatacaaatttttcacctctttggctaaattaattcctaaggattttattctttttgttgctaatataaatgggatttttttaaatttgcatttcagatagtttgttgttagtttatggaaataacattaattttttaacttttattttaggtccaggagtatatgtgcagatttcttatttaggcaaattgtgtgtggtgggcatttggtgtacagattattttgtcgcctaggtaataagcatagtacctaataggtaggtttttgatcctcaccttcctcccaccctccattttctttttttttttatgaacatggaatatgtctccatttatttggtttttctttttttttaaattatactttaagttctagggtacatgtgcacaacgtgcaggtttgttacacatgtatacatgtgccatgttacctaatgtaaatgacgagttaatgggtccaccctccattttcaaataggctctagtgtctgttgttctcttctttgtgtccatgtgcactccatgtttagctcacacttataagtgaggacatgcggtatttggttttctcttcctgcattagtttgcttaggataatggccttcagctccattcacgttgctgcaaaggacatgattttgggttttttgtttttgtttttgttttgttttgtttttgagacagggtttcactctcgtcacccaggctggagtgcaatggtgcaatctcagctcactgcaaacttcacctcccgggttcaagcgattctcccacctcagcttcccgagtagcagggattacaggtgcccgccaccgcacctggctaatttttgtatttttagtatagacagggtttcaccatgttggccagactggtcttgaactcctgacctcaggtgatctgcccgccttggcctcccaaagtgctgggattagaggcatgaactaccacgcctagctaatctctctctctctcttttttttttaaatggagtctccctctgttgcccaggctaaagtgcagtggcgtgatctcagctcactgcaacctccgcctcctgggttcaagtgattctcctgtctcagcctcccgagtagctggga[137 bp omitted]agctccgcctcccgggttcacgccattctcctgcctcagcctccagagcaggtaggactacaggcgcctgccaccacgcccggctaatttttttgcatttttagtagagacagggtttcaccgttttagccaggatggtcttgatctcctgacctcgtgatctgcccacctcggcctccca[135 bp omitted]ctcccaaagtgctgggattacaggcatgtgccaccacgcctgaccagtcttgttctttttacggctgtaccccatagtatatatgtaccacattttccatggtatatatgtaccatattttctttatccattctaccattgatgggcatttaggttgattcctcttttctattgtgagtagtgttgcagcgaacatacgtgagaaatgacactaatttttgcatattggttctgtatactgtaactttaccaagtttatttattagttctagcagttattttggtagcatttttagggttttctgcatatatgatcatgtcatcaggatatataaatcattatatttctcttcttatttggatgtcttttatttctttctcttgcctaactgttctggctaagatttccagtactgtgttgaatagcaggacaagagtgggcattcttgtcttgttccatatcttagaggaaaaactttcagtttttctccactgcttatgatgcttgtgatggtttttaatatttgggctttattgtgttaaggtaagctccttctatacctattttgttgagggtttttatcatgaagggatgttgaattttgtaaaatactttctttgtgtctattgaaatgatcatatggttctgctttcatcttattaatgtggtgtatcacattggttgatttgatatatttgtatattgaaccatccttgcgtcccactagggtttttgcatctacgttcattgaggatattggcctatagttttttttacttgtgatgtcttgtctggctcatggtatcagggtgatgctggccttataaaatgagtttggaagtgttccttcttccattttttggaagagtttaagaaattttggtattaattattctttgagtgttttgtagaattttccagaagcttgtctagtcctggacttttctttgttggaagctttttgattgctgatcctatctctttgttttttgtttttttttgagacagagtctcactctgtcacccaggctggagtgcagtggcgtgatctctgctcactgcaagctccgcctcccgggttcatgccattctcctgcctcagcctccggagtagctgggactacaggcacctgccaccacgcctggctaatttttcgtatttttagtagggacagggtttcaccgtgttagccaggatggtcttgatctcctgacctcatgatccgcccacctcggcctcccaaagtgttgggattacaggcgtgagccactgctcccggccttatctctttgtttcttattggtctcttcagactttctatttcttcttgattcagtcttggtaagttgtgtgtttctagcaatgtattcattttttctaggttattcaatatgttgttcataatagtcccctatgatccattttctgcatcatccattgtaatgtctccactgtcatttctgatgttcttttttctttctcttttttttctgtcactgtccacctagagatacatttctgattctattaatttgtgttttctcttttttttcttagtgtaagtttgttgattttatcttattgattgcctgtttcattccactgctgtctgagaagatacttggtatgatttcaatattcttaaatttgttaagactcattttgtgacctaacatgtgatctatcctgcagaatgttccatgtgcactaaagaggaatatgtattctgctgctcttgggtagagaattctgtatatgtctgttgggtccatttagtctatagtgttgttcaagtaagctgttttttaattgattttctgcctggatgttctatccattattaaaagtggggtattgaagtttcctactgttattgtagtgctgtcaattcctcccttcagatctgtcaatatttgttttaaatatttaggtgctctgatgctgggtgcatatatatttttaattattatattttcctgcagagttgatccttttatcattacataatgaccttatttgtctctagtgacagtttttgacttaaagcctattttgtctatgtaagtatagccacccatgttcaattttggttatgatttgtatggaatatctttttcctcattccttcactttcagcttatgtgtgtttttatatctaatgtcagtgtcttgtaaatagcatatcactgcatcttgtttcttattcattcagccactctatgcctttagattggagaatttagtccattaacattgaaaataattattggcacataaggacttactattgctattttattattttttatctgttttgcagttctttcatttctctcttgctgtcatcttttgttatgtaattgtttttgtagtttatcatctactgattgaaccacttgcagcagtctctgcctaatttgtttccctgcctccataattgcccttcttcaattctattgcaaatttatttatttatttttatttatttatttttttgacacagagtctcactctgttgcccaggctggagtgcagtgtcatgatgttggctcactgcaatctccgcctcctgggttcaagcgattctcctgcct[131 bp omitted]ctcggcctcccaaagtgccgggattacaggcgtgagccaccgccccagcctgcaaatttatttaaaccagtttagcctctcacatcatcaggtacttttcagtgatatcagtagcttctaatggctagaggtagctggggagtttagttcttcctcatcccccacaatctcccaaccagttggtatgttctaatgaaaacacaaatttggtgcaattctgtcaatcatgcattttttttagcacttagacgtagtcttgaaacctgtcttcacaagctccattaagccccatgtaggagcaattcacttgaagcacatgcagcagttctccagtagtagcattttagctcaatgggcagaccaggcaatagaatcatccattaggtgtcaggatgtagaaactagtagattcctagaactaagatgccactctgggatcaccagttttttaggcttcatttatgtgagggtagagagaagtgtccatccatgtatctagaacaccatttatttcatgaatgaatgactcttttatgtgaatgagcaacccctctagtgtaggtttaggtagattggttgcagtttttcagtaactgcctctggagggtggactcacaattagtgtctttatatgcaaactaagtgctgctggaaagtgtttgtcactgggggtacttcagatattaactgcccctagagtatgtgtatatctacatgtacatgtgtgtaagtctatgtgtatctcacactgtctctgcggagtatttttaagtaaattgtagaccatataacaaatctactctcccatatgtatctgtctacattgttcccctacataaaactcttttcttctatgattcttctatgttacctacaaaataaagtccaaattccttcaagtgacctacagaactgcccctgcccagaacagcccctacctcttccttccttgtgctttatggtctaatggagaactgccaaactgcttgtagttagcctccatcaacaatactgctgtatgcctgtgttttatgctcatgctctccccctgcctggtaaacctttcccaccttcacctggctctttttttttttttttttctttaacagagtctcgctctattgcccaggctggaatgcagtgcagtggtgtgatctcggctcaccacaacctccaactccctggttcaagcgattctcctgcctcagcctccagagtagctgggattacagacacatgccacca[132 bp omitted]cctcagcctccagagtagctgggactacaggcgtccgccaccacgcctggctaattttttttttgtatttttagtagagacagggtttcaccatgttgatcaggatggtctcaatctcctgacctcgtgatccgcccactttggcctcccaaagtgctgggattacaggtgtgagccactgcacccggccctcacctggctaactcttattcatcttctgtgactcagctccaggcatcagtccttccaaaaagctttcctgtaacctcatttggagttaagcttattcattttatctaacactggtgtagtgtagtgcttactctgtgtcaggaattatattctaagcacatttaatcctcacaactctatgaattaagttttgttattatcttgattttcagatgaggaaactgaggcacatagaggtttaagttgcccatgttcacataatttgtaagtggcaaatccacacttcagatccaggctgtctggctttgaaactgcctttgcaaaaattttaacagtgagaaaagtatggcagtgggggagatctgatctagccaatccccatcttgcctttagccttcaagctacccttaattattcctgggcttgggccaagctaactttgggagatatttagtttatagtttatttttattttgagacacagtcttgctctgtcacccaggctggagtgcagtggtgcgatctcagctcactgcaaactctgcctcctaggtgcaagtgattctcgtgcctcagcctcctgagtagctggtactacaggcgtgcaccaccacacctggctaatttttgcatttttagtagaggcagggtttcgccatgttggccaggctggtctggaactcctggcctcaagtgatctgcccacctcagcctcccaaagttctgggattacaaatgtgtgctaccacgctgggcctatagtttaaatgctaatagcccttacccaaaactcaactgccttttaaaagctaatgagagaccaccaggttaggaggataaaggagccgaattctgccaaagtgtagacataaacgattggtaaccattattccagaggtcaccagatacgcaacttccccatttactctgcagataacatcactattgtagaacctaagattggctttttgagatatcatttcagggttttcgcgtgtctgaaggactgatggctccacctgaacctgccaaccactcctgtggcctcaaccaaaagtgactcagtgcgcatgaggaccatttcccatacccccatgtttgtaccaccaaccaatcagcagcaagcacccattacttagctacccccatcccttcttctaaactgtctttgaaaaaccctagcccccaaattatcagggagactgattgcaatgatgactccatttcccacatggcatggctagcctcatatctattaaattctttttttggggggggggcgggtagagggtctcactctgtcatccaggctgagtgcagtggtgcaatcatggctcactgcagccttaaactcccaggctcaagagatcctcccaccttagcctcctgagtagctgggaccacaggtgtgagccaccacaccctgctaatttttgtattttttgtagagacagggtctcgccatgttgccaaggctggtctccaactcttgggcttaagtgatccacctgccttggcctcccaaagtgctgggactacaggcgtaagccactgtgcctggcctaaactctttctctattgcaatgccgtggtctggttttgtctgtgctgtgggcagaagaacccatcaggcagttatagctttggagtctgtgctctaaatccatatgcagtgctacttcccaagggcacatcctctgtattccggcatgcttctatcttagcatttagcataataattagaaaatgcgtcatttcatatgtgcctgctagtctaccatgaggctcttaaaatgtattaatatctaaggcagtatggtatagtggttaagatcatggagtttggaattagacagaactggggttaagttccatctctgctatgtattgggtgtgtaaccttaggcaaattatttaacctttctttttttttttttttttttagatggagtcttgctctgttgcccaggctggagtgcagtggcacgatgttggctcactgcaacttctgcctcccaggttcaagcgattctaccacctcagcctcccgagtagctgagactacaggtgtgcaccaccatgcccagcaagtttttgtatttttagtagagatagggtttcactatgttgaccaggctggtctcgaactcctgacctcaggtgatctgcctgtcttggcctcccaaagtgctgggattgcagacatgcaccaccatgcctggccaaattatttaacctttctatgacttgcttttttcacctgtaaagtggtatctcctcactcctagccagtgcttttccccaggggtaaacatttccaatctttctatttctgcaccctccatggtttatttctgactatctggacagaaaaagagaggacaattccagccttgtcctgagcataaaaccactagcatcgaccctagtttattttgtgcactgtgtgctttgactcatgtccagatcctcttcctcactctggaaccccctacagatccctcatgatctggctagagaccatataaagtggggctaagaatacctcacagggtaatggaaagaatgaaatgagatgatgtatctaaagcatctggcagagggtcttacatagtaagaaactctgagtaatgcctgacacttataactcgttattaatatctctccatctccagcaaccagcacggtgcctggacaatagacatttgagaactatttgttgaactgaactattttggaaaactttaggctgacatagacatctgaagcatatcttagtatatatgacttcagaaatgattctctgtagttaagcagaatgtgctacctcactttgctagggcacccaaaagagttttaactccaaagagtagatagccctgtaactctccagtcatgcaactaataagcatatctttctggtccttgaagccatcaattttaatgcagctgaagctcaaatgggatagctcaccactttgaagtcagacttgttatcgtaagtcatctcatcatcattcaaaatgaaagagaaccccatttcgtttcctttccttagaacaagggcttcagaactccccagggctagctagtctcattggatcgctgaccttttcagtattgaaattcctatgcaaatttccttctcagcatcccagggctttgatcctttgtgcgatgaattttatttgtcgaatggatgaaaaatgcagttatcagacatgcccaggtcacctttggagagtgttgtgataacaaatgtccccaaatgcgaccattgattttctcttcctttgaggaccttaaagagcctctaggttaaccccattatcatcagatcatcagtgatcacttctcagaagtttagctagacagaaaaagtggatgaaattgaactgaatttgtatcaatcccagtcattgcctaaaatctggcagttcaactaaaactctgatagttggttatgttgtcacttttctcttttccctgaaaactggtatatggaacctcccacccaccaccaacacgcacaaaaaagcccaactagtggaggattatggattcacatgttctgaggggatttaatttgaggaaagaatgactctagtgtggttttgatcaggagaggctgcctggagaaggtctctagccagaccatgaaggactggtaggggattccagagtcgaggaagaggatctggatgtgaggcaaagcacatagtgtgcacataataaactagggttgatgctagtggttttatgctcagggcaagactgggattgccctctcttctgtccaaatcatcagaaacaaaccatggaaggtccagaaacacagaggctgaaaatattcacccctagggaaaagcacttgctaggagtgggagatataatttattttcttttctttttcttttcttttctttttttttggagacaatgtcttgtaatatttcccaggctggagtgcagtggcaattcaccggcacgatcatagctcgctgcagtattgaactcctgggctcaagctatcctcccaccatgtccggcagaaaatatgatttctgatctttattctaccactgacttgttctatgatgatggtcaggtcatttaaacctctcttagatcatttccttggcaataagatagatgtataatcaggctaccatacagaactggtgggaagattatacgagagctcacaaatatctatcagatataagttattgagatactattattaaaatgtaaatatcacaggaagggagaccaccttcagtcttgtcagcttgcatcttattggataattaatgcagctgctcaaggaccccacgaaatgggcatcaagtacagagaagagagagaatttttttaaaacaaatgaagaaaccaaatctcagagagctttaatcactacccagttgtgaagcagggactatgccaaatcatttatcataaatgtaaattacttcactgttttgtgccaatactctggaaacctgtttgtatctcttcggaaggccctgccttccacaggaaggttctgccagacatggtgggaggatcccttgagcccaggagtttgaggctgcagtgagctatgattgtgctgggaattggtgagaatttcaagggtaagtggaaagctactgaggagagtattttggaggttggcagctaatctcagatacaaatagtttaatcacttggtgtgccttaatccacattgatctttgagtgacttgatagccccttaaacttcagaaggtaaacctgtttacttctactggtacagaattctaataaaaataaatgtattttgtgtatttggcacaactttgtaaatttttattctattctatgtaaactacaactatatatcattcctttgagcctaacttagaagagagaactgggagttcataacactaaaaaaggcggtaatatcataggcaaacatagcaaacattttttagggaagtctcaggagaaaggaagcaagtgaaagtaaagtgagcatggtaaagagttgcacttggtaggatcagggttcagggagttcaagtttatatcaaggtatatcagcacatgcctaggtagagggagaggaagaaggagaggtagagaagggagaaaaggggagaggggagagagggagagagaggagaggaggtagaaggagaaggaaggggcaagaggagaggagggagcaggcacacacacacacacacacacacgtgcacccacgcttacatgcaagcctgctgctctcccacacctggtaagtgtgtcagagccctcctggtgcttgtccttattcatcaaagccactccagttctctttctagtccctttgtcaatcactctccttctctgctaccagggaaacttgactgagaggaagagaaagctaaagaagtatcaaattcctctctaagacatcttcactagtcttccagaacatctccgccttgggaagcagaactctgaggtccaggaagaccttccgaccaatccactgagacattgctacggctgcctcctcttcactttctggcctcttgagccaacatccaacatgatcttcatgagaggttgccggttacctttctaaaaacgtatttgaccagatttcttcatgatatttcaaaatgtaaaggcagaaaacaagttaaactttaaacaaatttaaatttaaacaatctaaaagggaatttaagtaagcgtatgactttgttgcagaggttctaggcttccttttttacaaaaggatgggaaattttaaagcaactgctctgactaacccagaaaaatctttctttgtttatctcctttgtatttagccccaatatctgagaaaattttaaacatagtttttttttctaggattggtgcctaagggtcattcccttacgaaaaccctaactttttttacacctttgttgaatgaaggagctggtggaagttcaaatttgtgtgttaacatgtgacttcaattagagtctgaagatggccacttgttagtaatctcacactgcatcattttaaaaaaacacagcatttttgttctggtgaagagagaggcactggaattcatccccattgtccactccccacccagtgtattttacagaaattcttaacaagtttaatagtgtgctattataacataattgcagcattacaccagaagcattatcaacactaagtattctccaatttagaatgcatgaataaagtctctaaaactcttaagagtatcactttttctcagctaaataaactaagttcaaagggtaaaaggaatatttcttcttatattgaaggtagcatgtatttgggggtagtattttgataagcatttgtgagctccctgctggtggattttaaaacctccttggcaatctcatggtaactatgaggagtgcgaaagtgtctagagcattattatgtatctgttatggtaacactagctctgtcactttcaacatatggcatcaaaagtcaccctggatgctgacaaaactagtcaacgcatgggaaacaagaaagagtgggttcttagattggcctgaatgtcacacatacctgtcataaagtatcacctagatgcaagaggaactaagaaatggtagttccgatctgcagagccacctcgctgccactatttagcatgatgaaaaggcagtactgatatttgggggatagctaaatggctttgccacagttgtattttggcagttattaggttattgtctcagctccaaaaccagtcttttttttttttttttgagactgagtcttgctctatcacccaggctggagtgtagtggcgggatctcggctcactgcaacctccgcctcccaggttcaagcaattctcctgcctcagcctcctgagtagctgggattacaggcgcctgccaccatgtctagctaatttttgtatttttagtcgagatagggttttaccatgttggccaggctggtctcgaactcctgacctcaagtgatctcccgcttctgcctcccaaagttctgggattacaagagtgagccattgcgccgggtcccaaacccactcttctataccttatttcgtgatgctagcaataggacactgaaaaccacaagtcagttttgtctgctggctttgtgttagcttctgccaataggggtctgtagagggggattgcaaagctgaaggagaaaaggacttgctcctaggtgggttgcctgtctgcttgtagttcctatgagcgccaccccggccttgcctctttaccctgaaaagagcaagtccttcctgtagaattgagtgagtccagtttacagtttttccatcacttgaaagaaccaatctctgccgggcgaggtggctcaggcctgtaatcccaacacttcgggaggacgaggtgggcagatcacggggtcaggagatggagaccatcctggccaacatggtgaaaccccgtctctactaaaatacaaaaaattagctgggtgtggtggcacgtgcctgtagtcccagccactcgggaggctgaggcaggggaatcacttgcacccgggaggcgcaggttgcagtgagccgagattgcaccactgcactccagcgtggcgacagagcaaaactccctctcaaaaaaaaaaaaaaaagtaagagagtaagaactaatctcgacatgccctgctcatagacaacaccaacagtctgtgcccctccttagaaatctgggtcccaatgtgtccggaattggtgggttcttggtctcactgacttcaagaatgaagccgcggaccctcgcggtgagtgttacagctcttaaggtggcacgtctggagtctgtcccttctgatgttcagatgtgttcggagtttcttccttctggtgggttcctggtctcgctggctcaggagtgaagctgcagaccttcgcggtgggtgttacagctcctaaagtagcgcgtctggagttgttcgttcctcccggtgggctcatggtcttgctgggctcaggagtgaagctgcagaccttcacagtgagtgttacagctcataaaagcagcgtggacccaaagagtgagcagtagcaagatttattgcaaagagcgaaagaacaaaccttccacgctgtggaaggggccccaatcaggttgtcaatgctggctcaggcagcctgcttttattctcttatttggccccacccatatcctgctgattggtagagctgagtggcctgttttgtcacagtgctgattggtgcgtttacaatccctgagctagatacaaaggttctccatgtccccatcagattagttagatacagagtttggacacacaggttctccaaggccccaccagagcagctagatacagagtgtcgattggtgcactcacaaaccttgagctaaacacagggtgctgattggtgtatttacaatccctgagctagatataaagactctccacgtccccaccagactcaggagtccagctggcttcacctagtggatcccgcaccgggactgcaggtggagctgcctgctagtcctgtgcagtgcgctcgcattcctcagcccttgggtggtcgatgggactgggcgctgtggagcagggggtggtgctcgtcggggaggctcgggccgcacaggagcccatggagtgggtgggaggctcaggcatggtgggctgcaggtcctgagccctgccccgcgggaaggcagctaaggcccggcgagaaatcgagcacagcgccggtgggcccgcactgctgggggacccagtacaccctccgcagccactggccccggtgctaagtcgcccattgcccggggccagcagggctggctggctgctccgagtgtgggggcccaccaagcccacgcccacccagaactccagctggcccgcaagtgccgcacgcagccccggttcccgctcgtgcctctccctccacacctccctgcaagctgagggagtgggctccggccttggccagcccagaaaggggctcccacagtgcagtgggggggctgaagggctcctcaaatgccaccaaagtgggagcccaggcagaggaggtgccaagagcaagcgagggctgtgaggactgccagcacgctgtcacctctcaccagcatcacagggatcctcttccaagctcagagatttcagcaccagcaagcagatgaccccttttcagaagtatgggttttagctccatggagcccctcccccaaggaagctcctaggcttcccaggcttcttgatct[144 bp omitted]aaaactctgtctctactaaaaatacagaaattagccaggtgtggtggcacgtgcttgtaaccccagctactcaggaggctgaggcaggagaatcacttgaacctgggaggaggagg[134 bp omitted]aggaaatatggattcacatactcaagttgttccaagcatacttaacatttttcattagcggaattataaatttttaactttttactttgggataattatacactcaaaagaagttgaaataaatagtacagagacgttccatgtacctatcacacagcttctcccattggtgacattttctgtaattacagtgcattgtcaaaacgagaacattaactggcacaatgcaactaaccagactggaagtcttaattaggtttcaccagttttggcatgcacatattgtttttttgtatgtctttgtgattatataacatttcctcacgtgtatagatttaaaaaattgtttaattttaatttttgtgggtacatagtaggtgtatatgtgtatgaggttcatgacatgttttgatactggcatgtaatgcataataatcacatcatgtaaaatgggatatccatcacctcaaccatttatcctttgtattataaacaattcagttatactcttatagttatttcaaaatgtacaattacattgttactggctatagtcaccctgttgtgctatcacacactaggtcttattcattctttctattttgtgtacacattaaccatccctaactcctgcccttccccctactacatttcccagcctctggtaagcatccttctactctctctctcttattttttttgagaaggagtcttactctgtcgcccaggctggagtgcagtggtgcggtcttggccactgaaacctccgcctcctgggttcaagcgattctcctgcctcagcctcccgagtagctgggactacaggcatgtgccaccatgcctggctaatttttatatttttactatagaatgggctttcgccatgttggctaggctggtctccaacgcctgacctcaagtgatttgcctgcctcagccttccaaaatgctgagattacaggtgtgagccaccacacccggccaccatccttctactctctatctccataagttcaattgttttgatttttagatcccacaaataagtgacaacatgtgatgattgtctttctgtacctggcttacttcatttagcataatgacctccagttccatccgtgttacaaatgacaggatctcactctttcttatgactgaatagtataccattgtgtataattaccacatttctttatccattcatctgttgatggacacttaggttgcttccaaatcatggctattgtaaacagtgctgcaacaaacatgtgagtgcagatatctctttgatatactgatttcctctcttttgggtatatgcccagtagtgggatggctcgatcatatggtagctctcatgtgcatagatttgtgtgaccactgccactacaatgaagagacagaactgctccattactaccatggaagttcctcatgctgcccctttatttttacttcctctcttccctacaactaatcctggcagccacttatatatgctccatctatataattttgtcattttgagaatgttatataaatggaatcatacagtatgtgacattttgagactggctttttttaaatttaaattttaatttttgagaccaagtctcgctctgttgcccaggttggagtacagtggcgtgatctcggctcactgcaacctccgccatccgggttcaagcgattctcgtgcctcagcctcccaagtagctgggactacaggcacaggccaccacacctggctaatttttgtatttttagtagagatggggttttaccacattggccaggctggtctcagactcctgacctcaggtgatccacccacctcggcctcccaaaatgctgggattacaggcatgagccaccgtgcctagctgaaactgtcctttttattcagcacaatgcccataagatccatcttggttgttggatgtagcaatgatacgttccttttttattgctgagtaatattccatggtacggatgtaccacagtgtgtttaatcattcatctgttgaaggacatttgacttatttttaaattttggttattacaaaaaaagctgctatgaacatttgagtataggtttttctgtaggtatgggttttagtttctctgggataaatgcccaggaatgtgattgctgtgattgctgcaccatatggtaactctatgtttaacttttttttttttttttagagatggagtctcactctgttgcccgggttggagtgcagtggtgtgatttcggctcactgcaacctccgcctcccaggttcgaatgagtctcctgcctaagcctcctgagtagttggactacaggctcgtgccaccacgcccggataattttttgtatttttagcagagacagggtt[143 bp omitted]agtggctctgccctttattattattattattatctttattgatatggagacttgctctgttacccaggctggagtgcagtggcatgatcttggctcactgcaacctctggctcccagattcaagcgattcttctgtctcagactcctgagtggctgagattacaggcgcctgccaccaagcctggctaatttttgtacttttaatagagacagggtttcaccatgttggccaggctggtctcgaactcctgacctcaagtgatctgcccacctcagcctcccaaactgctgggattataggcgtgaaccaccgcgcccagcctgcctctaccattttacatccctaccaaaaacatatgaaagatcctatttcttgacatcttcatcagcatttgttgttatcagtgttttctttttcagacatttgagtaggtgcataacagcatttcgttgtgattttgattggcatatccctaatggctagtgatattgaacatcttttcatgtatatatctgccaccagtatattgtctttggtgacatgtctgttcaagtcttcttttacccatttaaaaactgggtggttggtttattacagatgagttttgggagttctttatatattctggatatatattctttgttagagatgtgatttgcaaatatgttctccctgactgtagcttgttttttgtttgtttgtttgtttgtttgttttgagacagggcctcactctgttgcccaggctgcagtgcagtggtgtgatcatggctaactgtagccacaatctccctggctcaagtgatcctcccacctcagccccctgaatagccgggactacaggtgcatgccagcatgcccagataattttttttttgagacaaggtctcatcttgtcacccaggattgagtgcagtggcacaaccttggcttcctgtagccttgaccttctgggctcatgcgatcctcccaccttagccaccaagtagctgggactacgggtgcacgccaccatgcctggctaatttttgtattttttgtagagacggggtttcgccatgttgcccaggctggtctcaaactcctgagctcaagcgatcggcccgccttggccttccaaagtgctaggaatacagccatgagccaccacgcctagccccagagcttgtctttttatcatcttaacagatgtctttcatagagcagaagttctgtgagcttttcatcaatatgtttaggttttttccttctatgcattgtgcttttggtgtcatgtctatgttcccttcacctaactccaaatcatggtgattttctttctactgtgttttcttcttcttcttctttttttaagacggagtctcactcttttgcccaggctggtgtgcagtggcatgatctcagctcactgcaacctctgcctcccaggctcaaacgattttcctgcctcagcctccccagtagttgggattacaggcgtgcaccaccacacccggctaatttttgtatttttagtagagtcggggtttcaccatgttggccaggctggtctcgaactcctgacctcaggtgatccacccgccttagcctcccaaccaaattgctgagattacaggcgtgagccaccgtgcccggccttttcttttttctttgtctttcttcttcttcttcttcttcttcttcttcttcttttttttttttttttttttttttttttttttttttttttagacagtgtcttgctttgttgccaggctggagtgcagtggtgcaatcttagctcactgcaacctccgcctccctggttcaagcgattctcctgccttagcctcccgagtagctgggactacaggcgtgcacgaccacgcccagctaatttttgtatttttagtagagacggggcgtttcaccatgttggccaggatggtctccatctcttgacctcgtgatctgcccacttt[138 bp omitted]cctctacctcccagtttcaagtgattctcctgtctcagcctcctgagtagctgggattagaggcatgcaccatgacactctgctaatttctatatttttagtagagacagggtttcaccattttgcccaggctggtctcaaactcctgaactcaaatgatcggctcaccacagtctcccaaagtgctgggattacaggtgtgagccaccatgcccagcctcctgtgttctcttctaaaagctttataattttacatttaaatcaaagatcaaatttgagttaatttttgtataaagtatgaggcttaggtataggtttattgtttatttctgcctatggatgtgcaaattttccagcaccatttgttaaaaagaaaattcccgtgtttctggggtcccatgaccaccccaggtttagtgattcactagaaggagtcacaagagtcaatatagcaggttttactcactgctaaagtttattaaggaaaggaaacagagcaaaaacaacaggaaaaatgcatgcattggacagagtccagagaggtcaggcatagacttccccatctgaagccacacaggatgtgctttctctcttgcagtgaactacaggaccatgtgaggaataactctgcccagagaaatctgttcaaacctcagggtctgcggcttttatgtgtagaggaacagctctgtcatggcaacctgacaacagagaccacacagacaaagacttgacctgcagtttatctgaatcttggcagaactccttgtgatcttctcggtatacaagaggataagaggtcccttttgttttgatgtcatcctttttggtgtgtgaaacaaggaccacagggagctggcacctttggctacacttcttttcactccccaggtaagtaataaactgtctgaatcttaaaagcactcatagtgtcttttttattggcgaagtctgtcaggccttagccttttctcacacttcaccaaattacttttgcatcttcgtcaaaagtcagttggacatatttgtgtgggtcagttctttctaacagctttactgaagtatgactggcatacaataaactgcacatattttaagtgtacaatctcactttgaccctcaaagggtctcactttgttacccaggctggtgtgcagtggcacaaacatggcttactgcagcctcgacctactgggcttaaatgatcctcccacctcagcctcccaagtagctgggacttacaggcattcacaccatggctgactaattttttaaaaaaaatttagtacagacgagatcttactgtgttgcccaggctggtctcaaactcctgaattcaagcaatcctcccgtgttggcctcccaaagtgctaggattacaggcgtgagccacct[137 bp omitted]acctgtctctactaaaaacacaaaaaatagccagacgtggtggcacacacctgtagtcccagctaccttggtgaggtggaagaatcctttgaaccccggagacggaggttgcagtgagccaagatcacaccatttcactccagcctgggcaacagagcgagaccctaactcaaaaaaaaaaagaaccccccccaaaaaagaatttatacgttttgattcattgattgattgaatcatacatcaatttttttctgacttctttcactcagaagaattattttcagattcacctatgttagttttttttgttgttgctggtttttttttttttttttgagacaaggtcttgctactgcccaggctggaatgcagtagtaccatctcggctcactgcaacctctgcctttctgggctcaagtgattctcctgcctcagcctcctgagtagctgggactacaggcgtgcaccaccacacccagctaatttttgtatttttagtagagacgggggtttaccatgttggccaggatggtctcgatctcttgacctcatgatctgcccacctcggtcttccaaagtgctgggattacaggcatgagccactgcgcccggccacacctatgttattatatatatcaatagtccttttctttttttgctaagtagtattttgctgtatggctataccacaatttgtttatccatttacctgttgatgcacatttgggctctttccagtttgtaactattgcaaataaagcttctacgaccatttgtatataaaactgaagtgcaatggtgcgatccacaggatggagtgctgtggtgtgatctcagctcactgcaatctccgcctcctgggttcaagcgattttcccacctcagcctcctgagtagctgggactacaggtgtgtgccatcacgcccgactaatgtttgtatttttagtagagatgggttttgaccatgtgggtcaggctggtcttgaactcctgacctcaagcaatccacttgcctccgtctcccaaagtgctgggattacaggtgtaagccaccacgcccgaactaagtggtattttaaaatttcaatttcaattgtcaattactaatatatataaatgaaattttaaaaaaacattaatgatgtagcctgcaaccttgctaaactcactttcagttctagaactttttttagattgtaactggttttctgcatatgagcaattatctccaagtaaagagaatacttcttcctttatcatttgtgagcttttattgcattttattttctaatttctctgtccagaccctccagtacaatgtttgctatggtctggatgcatcccccaaaattcatgtgttggaaacttgatccctagttgcagcagtgttgggaagtggggccttttgggagatgtttaggttttgagggctctgccctctaaatggattaatgccattataaaaaaaggacttgtgggagtgggtttgctctcttctaccacatgaggacacagcgttcctctcctccagaggatgcagtgtttgaggcatcatcttggcagcagagaggtcaggctctaacctgctggtgacttgatcttggacttcacagccttcagaattatcagtaattaatttctgttctttgtaaattacccagtctcaggtattctgttataacggcacaaaacagactaaggcaatgctgaatataagaggtgagaacaaacatccctgacttgttactgattttataaggaaggcacccagtctttcaccattaagtttgttaggtataggattttcatagatgtgctttaataggttgaggatctttacttctactcctatattgctgagaattgttatcagccatagatattggttttgtcaaatgatttttctgcatctattgagatgagcccatggcttttctttgttaatttattaacatggtcaattatattgattgattttcaaatgtaaaccaaccttgcattcctgatataaaccacacttacacatgatgtattattttttttttaatttttaatttttgtgggtacatagtaggtgtatgtatttatgaggtacatgagatgttttgatatagtcatgcaatgtgaaataagcacaccatgaagaatggggtatccatcccctcaagcatttatccattgagttgcaaacaattcaattacactctttaagttattttaaaatgtacagttattattgactatagtcaccctgttgtgctatcaaatagtaggtcttagttattctgtctactgtttttttttggacccattatattttttatattcttatattgctagattcagtttgctaatattttgtttagagttttttgtttctatgttcactaggggatattggtttgtagttttatctgtcttgcttcggtatcatggtaatgctgtcctcatagaatgagttaggaaatattccttcctttcaatttcctggaagagtttgggtaaaattgatgttatttcaaaccttaagtttttggtagcgataactagtgtaaacatccaggtctggagttactaaactggagtttactagtgagaagctttttaactacaaattatatttctatgataggtttaggggtattcatttttgtgtgtttgtatgtgtgtgtatgtatctctatacatacagatagatagataggtagatagctagatagagatataatctcctttaatgagctttagtagtttatatctttcaagcaattagcccatcccatctaagtcctcaaatttattgctataaatgtgtttataatattcccttattaacctatttagtatttgtagaatctgtgttaatagtttttttttttttttttttgagatggagtcttgcactgtcgcccaggctggagtgcagtggcgcaatctcggctcactacaagctccgcctcctgggttcacgccattctcctgcctc[212 bp omitted]attggtaatttgtgtcttctctttgtcctgatccacatagccagagttttatcaattttgcttattatccaagagaaccagcttttggtttcattaaatttctctaatgattttctgttttctattttattgatttctacttcttagtttttgcttaatttgatctactttttcaatttattaatgtggaaatgatgtcaatgatctgaaatcttttttcttttcttacatatgaatatagtgctataaattttccactatatagtgctttatggtatctcatattttgatatattgtatttccattttcattcagttaaatatgccttccaattccacttttgattttttcttgaattcatgttttacttataagtatgccgtttaacttccacatatttgagtattttccagctttctgtttttagaatattatttaattccattgaaatcagaatacatactttgtatgacttgaatacacgttttgctttgtgtattttgaagatttgtcaagtacacaaacatttaggacagttatgtactattgatgaattgacccctttattattatcatcctaccgtgatatttgctgctttgaaatctacttgtttgtcactaatatagccatctgtctttcctgcatctggtgttagcattaattaactagatctattagtttctcatggctactataacaaattactgaaatgttgatggcttaaaaaacatttattctcccacggttccggaggtgagaagtctgaaatcaaggtataggtaagaccacacttccatcatagagtctgagggagaatatattctttgcctcttccagtttctgctgtctgtcagtattcgctggcttgtggctacagctctatctctttctctgctccgtgttcatattgccttctcctctgtgttagtgtagctaaattagctctctttctctcctataaggatacatgtgattgcatttagggcctacctggacaagctcctcgcaaaagccttaagttaatcacatattttgccacgtaaggtaatatttacaggttctggggattagaacatagacatatctttggggccaccactgagtccactacacatggtatatctttctccatcactttatttttcactggtttgtgtatttaaagtgtgtttgttgtgaacagcatacacttaggtcttgcttttttgcttttttattatccagtctgatggtctttttcttttttttgagacagggtcttgttctgtccctcaggttgtagtgcagtggcctgatcatggctcactgtagcctcaacctcctgggttcaagctacacaaacacacacacacacacacacacacacacacacacacacatatattattgtagtctccctttgagttatattatatcatttcacaaataatataagaagagccttccaatagtatacctacatttcctctctcctggcctttatgctgttgtttgcatatattttacttacacataaattataaagcccacaatgcattgttactatttttgcttagtcaattatcttttaaagatatttatgaaataagaaaaatatcatatatatttattcatgaagtttctgtttccagtgttctttattgctttactatagatccatattttcatctggggtcatttcttctgctgctcttcttcctggtctttcaggccaggcatggtggctcatgcctgtaatcccagcactttgggaggcccacgtgggtggatcacctgaggtcaggagttcaagaccagcctggcctacatggtgaaaccccgtctctactaaaaataaaaaaattagctgggcgtggtggcagttgcctgtaatcccagctacttgggaggctgaggcaggagaattgcttgaacccaggaagcaaaggttgcagcaagctgacattgcaccattgcattccagcctgggcaacaagagtgaaactccatctcaaaaaaaaaaaaaaaaaaaggatgtctttcagcatttactacaattcaggtctgttggtgatga[141 bp omitted]aaaccccgtctctaccaaaaatacaaaaaattagccaggcgtggtggcgggcgcctgtatcccagcttctcgggaggctgaggcaggagaatggcgtgaacctgggaggcggagcttgcagtgagccgagatggtgccactgcactccagcctgggtgacagagcaagactctgtctcaaaaaaaaaaaaaagtctttattttgggatgggcgcagtggctcacgcctgtaatcccaacactttgtgaggccaaggcgggtggatcacgaggtcaggagttagagaccagcctggccaatatggtgaaactctgtctctactaaaaatacaaaattaggcgggcgtggtgacatgcacctgtagtcccagctactcgcgaggctgaagcagaagaatcacttgaatccgggaggcggaggttgcagtgagcctagatcatgccagtgtactccagcctaggcaacagagactctgtctcaaaaaaaaaaaaaaaaagaaaaagaaagaaagaaaaaaagtctttatttcaccctttaaaaaaatttacattgtggcaaactacacataacacaaaatttatcatcttaataattttcaaatgtatagttcagtggcattaaccacattcacattgttgtgcagccatcattatcagttatctccagaactactcttattttgcaaaactagaattctatatccattaaacagcagccccccattatcctctactcctagccctgacaactagcgttctattttctttctttcttttttctttctctctctctttctttcttttgttctttctttctttctctctttctttctttctttctttctctctttctttctttctttcttttctttcttttttgacagggtctcactctgtcacccaggctggagtgtagtggcatgatatagagctgctgtgatatgtaggtttatagctttcatcaaattttgaaaacatgggcaaatatttcttcatatttgttttgtttcccttcccttttctcctctcctctggggattacaattatacatatattaagctgcttgaagttgttcaatagctcactgaatttcttttcattttttaataattattttattattctctctttcactggatagtttctattgacatgttttcaagttcatttatctttccttctgaaatgtctgatctattgttaatcctatcagtgtgttttatctcagatactataattttcatatctaagtttcattttcatctttttaatatattacatggttctacataacttttttaccacttaaaatacaattacaataaatccttaaatatcctggtctactgattctaacatctatgttagttcctggtccattttaattaattgatttttaaaattacttgaacatagttttatccttttcagtctttcttttaagatccgttaggttggagcacagcagtgtttttttctagggctaattatttcccactacaagggaagatccttctgaataatctatcaatttaccattaattatgaggttttccagtctgcctatttgggacagacagtattccaagttctgtgtatatgttgggtactgttccttttttttttttttttttttttgagatggagtcttgctctgtcgcccaggcaagagtgcagtggtgtgatgttgcctcagtgcaagctccgcctcccgggttcacgccattctcctgcctcagcctcctgagtagctgggactacaggcacccgccaccatgcccagctaattttttgtatttttagaagagatggtgtttcaccatgttagccaggatggactcaatctcctgacctcgtgatctgcccgcctcgggctcccaaagtgctgagattacaggcatgagccagggtgccgggcggggtactgttccttttagtcctcttgtatagtcctttccttggcttctggtagttccctcacatgtacacacctatcagtacttgaaggtgacccaccaaaactctctagagttctccttctgtgtacttctctcctttctggtattcttccctgcagtctagctgctttgagctccctgaactctcagtcctgtctcttcaactcagggagtcctcctggctctacctcaccttccctgtgccacagccaggaaactctcttcagtcagtaatctgggacaatcctagagctcacctcacttatttcttttctctcagagaatcactgctcttcttgtctgctgtccagcgtattggaaaccatttcatatatttgatccaatattcagtagtttcaaatgtgagggtaaattcagtctctattatttcatactggctagaagtggaagtaccaactaatggtttctaaatataaatttaaatgaattaaaattaaataaaaattaaaattcagttcatcagttgtactagctgtatttcaagcactcaaacgctgcatgtagctattgtattggacagcacagtcttatctgtgctgggtaaaaagttatctttttaccctttaagctacttagttaacaactataaacctagttaataattatttatattaaatcgtctttgaccaaatagctcatgtgatttctttcttctgattagaacctgcttgatacatttattcaggtagttccattatcaaggaagtatggtgacaggccttagaatcttaatgacatgggttcagttgtcacttactagcggtacaagcaaattacttcatctagctaattctcagaatattaccaggaaaaatgaggacaatgttaccaggaaaaatgaggataatattacctgcttcccggagtttgttgtgaggatatatgaaaatatctgacacatagtagatgctcaatatatagtatttccttttattaatttcttcatcatcatcctccgagcacttagatctatccatctcagaaacagcttccaagagtatttcttcccatcttcctgtcaaaaccacaatgtgctttgtcccttttccttgggactgtttttccacaaaggtttatcttgaaaagcaatcatgggtactgcagcacactggctggagtagaggactttggatgcatgactctcccgctcccaaaaacagccccacaacctgccgccccgcaccaccttggcccagctcaggtgacatgtatacctgccagagcgcaatgacgggtgtttggctcttgtttctgctttgagttcttttcaagggaccaggactctagctgcatagttgtgcagggaactacacaccaaaagcaagtgaacaagtctgaatagtaagagttacgtggatcgattgtttaccagagccaggcaccaccaaaagaaatgtgcacactttatcccatgtaatcctccctctgggcctaaaagagcagctggtgtgactgcaggcacccacctcacgtcatggagagctgagtgtatgccgatgggggctcttgagaccccaggtgtgcctgggaggagaggaggaagatgaaggcccatgctcccccacctcctggaaaggctgccactctgcacgtgcacagccaccagaagaccccaaagacagggccctcaggttgcagcagaacctggtcctcatgaaggaggcgctgagggccaccatcatggacgtcaccatggtcctgcccagcaagctggagaagaggagcgtgctcaatgggagccatgcaatgatggacctactagttgaactttgccttcagaaccacctgaatccatcccaccacgcccttgacatttggtcttcagaaacccaacaacctttgagttttaagccaaatactttgattgggaccctgaatgtgcatactgtgtttctgaaagaaaaatttcctgaagaaaaaattaagcctgttccccctaaggtgcctgagaaatctgtgtgtttggtcgtgaattacttgcagacacaaaaagctgttgtgcatgtgagccctgaggttcctctccagaatattctcccagccatttgtgcaaagtgtgaggtcagcccagagcacatggttctcctcagggacaacattgccagggaggagctggagctgtccaagtccctgaatgagcttgggataaaggagctctactcgtgagacaacagaagagaaacctttagaaaatcatcgcttggcaatgatgagacagataaagagaagaaaaaatttctgggatttttcaaagttaataaaagaagcaatagtaaggctgagcagctcgtgctgtcgggtgcagacagcgatgagggcacctcccggctgcccctgggaaggggtttgaatggctgtttaacaacacccaactctccatccatgcactgaccttccattacactgggtccatccctcttgctgggcagcatctcaggggcgtctgtgaagtcagagatgaagaaacgctgagcccctcctcctccaggttcagggccacctgtgaaagacaaggcattggaaagggctggacatagtgcctcatgcatgtaatcccagcactttgggaggctgaggcaggaggatcacctgagatcaggagttcaagaccaaccatggctaacatggtgaaaactcgtctctactaaaaatacaaaattagccaggcatggtggtgcaggcctgtagtcccagccactcgggaggctgaggcaggagaatcacttgaacctaagaggcagaggctgcagtgagccgagattgtgccactgcactccagcctgggcaacaagagcaagactccgtctcaaaaaatatatatatatacacacatatatatacacatatatacacatatatatacacatatatatacacacatatatatacacatatatacacacacatatatacacatatatacacatatatatacatatatatacacacacatatatatacacatatatacacacacatatatacacatatatatacatatatacacatatatatacacacacgtagtgtgtatatatatacgtatatatgtgtgtatgtatacatatatatgtgtgtatatatatacgtatatgtgtgtatatatatgtatatatatgtgtgtgtatatatgtatatatgtacgtatatacatatatattttctaatgtgactgacttattttgagtacttcatgatatgatagctgcattttcataaaaagaaatttaggcacaaatggtacctttttcttgtatgggtctatgataagattatgcaaatggaaaacacgaagctgtttcttctgattaaaaaaaagcaatcatggcagaacaaagctagaggactaatacttcctgatttcaaaacttactacatagctacagtaaaaactgtggtactgcaaaagacagacatattgaccaatggaatagaatagagagcccagaaagaaactgtcacatatatggtcaaatgatttttgacaagggtgccaagaactattcaatggggagaggagagtcttttcaacgaatgatgctaagaaaactgtatatccatctacacattaaaagaatgaagttggacccttacctaacaccatatacaaagattaactaaatatgaattaaatacataaatagaagacctaaaactataaaattcttaaaagaaaacagagcaaaagcttcatgacattggatttggcagtgatttattggatatgacaccaaaggcacaggcaacaaaaaaaaatgaacacattggacttcatgaatattttaaaaattttgtacattgaaagatagtatcagctaggtacagtggcatgtgtctctgataccacctacttggactgaagcaagaggatcagtccaggagtttgaggccagcctgggcaacataaggcaaccctgtctctaaaatgtaataataataaaagaaatagtatcaggctggatgtggtggctcatgcctgtcatcctagcactttgggaggctgaggcagaaggatcacttgagctcaggagttgtttgtttgtttgttttgagacagagtctcgctctgttgcccaggctggagcgcagtggcgtgatctcagctcactgcaagctctgcctcccgggttcatgcaattctcctgcctcagcctcccgagtagctgggaccacaggcacctgccacc[138 bp omitted]ccccaccgagctcaggagtttgaaaccagcctgggcaacatagtgagacctcatcgctacaaaaaaaaaataaaaattaactgggtgtgttgcttcacccatgtagccccaggtactcgggaggctgaggtgggaggatcacttgagcctgggaggctaaggctgctgtgaaccatgatcatgccactgcactctcacctgggcaacaaagtgagaccctgtctcaaaaaaagaagaggaagaagaagaaggagaagaagaggaagaagaagaaggagaagaaggagaagaggaggaagaagaagaaggagaagaagaagaggaggaagaagaagaagaagaagaagaagagaagaagaagaggaggaggaggaagaggaagaggaagaagaagacgaagaagaagaggaggaggaagaagaagaataggaggaagaacaagaagaataggaggaagaagaagaagggagaagaaaagaaaagaagagaagaagaggaagaagaagaaggaggaggagaaggaggaagaagaagaacgagtatcagcaaagtaaaaagctaacctacagaatgggagaaaatatttgcaaatcatatatctgataagatattcatatccagaatacatgtggagaactcctaaaactcaagcacaacaacaacaaaacgaacaagccaattcaaaaatgggcgaaggacttgaatagacatttctccaaagatatacaaatggccaaaaagcacaaggaaagatgctcaacattactaatcattagagaaatacaagtcaaaaacacaatgagataccacttcacatccattaggatggctactataaaaaaaacaacagaaaatacaagtgtttgtgaggatgtggagaaatttgaacccctgtgcactgttggtgggaatgtaaaatgatacagctgctatggaacacagtatgatggttcctcaaagaattaaaaatagaaatactatatgaggccaggcatggtggctcacgcctgtaatcacaacactttgggaggccgaggtgggtggatcacctgaggtcagggatttgagactagcctggccaacatggtgaaaccctgtctctactaaaaatacaaaagttagctgggcgtggtggcatgcacatgtagtcccagctactcaggaggccgaggcaggagaatagcttgatcccgggaagtggaggttgcagtgagctgagatcatgccactgcattccaacctgggcaacagagcaagactccatctcaaaaaaaaaaagggaagaaggaggaaggaggaggaaggaggagggggagaagggagagaatggaagaaggagaaggaggaaaaggagaaggaggaggagaaggagaaggagaagaaagaaggagaaggagaagaagaagaggaagaagaagaagaggaagaggaagaagaagaagaaggcataatactatatgatccgaagaagaagaagaaataatactatatgatccagcacttccacttctgggtatatactcaaaagaactgaaagcaatgcaggctgggtgtggtggctcacacctgtaatcctagcatgttgggaggctgaggagggtggattgcttgagccccgggcttcaagaccagcctgggcaacatagtgggaccccatctctacaaaaagaaatacaaaaattagtggggcatggtggcacgtgcctgtagtcccagctacttaggaggctgaggtgggagggtcgcttgagcctgggaagttgaggctgcagtgagctgcgatcatgccactgcattccagcctgtgtgacagaggcagaccttgtctcaaaacagaaaaaagaaagcaattcaattattttctctaaaagtctcaaaaagagatttgtatgcccgtgttcatagcatcattattcataatagctaaaatatggaagcaacccaagatgaatggatagcaaaatgtggtatatacacacaatcgaatattattaagctttaaaaagaaggaaattctgatatatgctacaacatggattaaccttgaggatattatgctaagtgaaataaaccggtcacaaaaagactatatgattccacttgtataagatgcatagagtagtcaaaataatagatagagaaagtagaatggtggttcccatgggccagaggaaaggggcaatggggagttaatgtttaatggtttaaatgttgcagataccaggataaattcacttttgtcaaacccaaacgaattggagccaggaaagcaggaaggaggagagttcatgcctgcatgtataagataaagactgtgtctcaaggaccttctaaaataaccccacaagatattccttttataggactgcagcaattcagataagatggtctggaaagaacacttggctagcacagcatctccatcaatgaactgatgccaactctgattttgaacctcctgaaccaatgaacttcatttccaacagcttatgtgaaattatcttcgccaataaaagcttccccttccccttcctttttttttttttttttttttttttgagacggggtctcgctctgtcgcctaggctggagtgcagtggtgcgatctcggctcactgcaagctccgcctcccgggttcacaccgttttcctgcctc[210 bp omitted]aggctggaatgcagtgacgtgatctccgctcactgcaagctccgcctcccgggttcatgccattctcctgcctcagcctcccgagtagctgggactacaggcgcccgccaccgtgcccagctattttttttttttttgtatttttagtagagacggagtttc[131 bp omitted]gtggcttgccatagctgtgcaccccagattataatcctctctgcttactactaaataaatgcctcaaattaggagatttttttcctggtgtctttcttttattttttatttatttttattttttgagacggagttttgctcttgttgcccaggctggagtgcaatggcacgatctcagctcttcaacctccacctcccgggttcaagcgattctcctgcctcagcctcccgagtagctggaactacaggcgcccaccaccatgcccagctaattttttttgtattttagtagagacggggtttcatcatattggccaggatggtctcaatctcctgacctcgtgatcagcctgcctcggccttccaaactgctgggattacaggcgtgagccaccacgcctggcctcctggtatctttctttaaggttgataatgggtggtcagatgcggtggctcacgcctgtaatccctgcactttgggaggctg[134 bp omitted]gaagcaggagaaccgcttgaaccccagaagcggaggttgtggtgagcagagatcatgccactgcactccaacctgggcaacgagagtgaaactctgtctcagtaaataaataagtaaataaataaacttgataatggatataaaattccagttttacaagatgaaaagaattctagagatggagggtggtggtggttgcacattatgaatgtagcgaataccactgaactacacacttaaaatagttaagatggtaaattttgttatatgtattttactacaatttttaaaaatggaaaaaagtaattatagttcattgttcacaaattatgatggcttagaatgttccctttcccagaaaaccagaggaagtaatatattttaggtaccatggtggggtcaataaaggagatattagtggtggaggcaaacttctgattgccccagcatagctgacagtgacttctgcatggaaccaagctgaaggatgttaaaactgacttttttttggtgccatgagaccattatcagctctaacacctgagatggccaactttttattatctgagtataaattatcctcgtcatcatttaaatgccccctgcatcatatatgccacctgcaacaacagatatgtctgtgtacacagtcaggcacatatttttatcaatggttctcaactagaggcaattttgccttctagaggacatttggcaatatctggagacaatttcagttgtcacaatttggggagggggttgtcgcatgtcgtgggtggagaccagggatgctaccgctaaacatcactataaggcataggacagcttcacacaacagagagttatcaggccttaaatgtcagtagtgctgaggttgagaatcactggcctaatctgagctcaaaaggaaatgtaaatctgctctgcagccccagaacataataccatgctttccagggctcaatactattgacttttggatttcacatgctattgcttccactttttttggatggaaacttgaaggttgactatgtggtacaaatatacttaaatgtaacccagagcagcagagttttgtttttttttaaggtttccactttgttttctgctaacttgataaatcaatgattttacacaaaatattttacattgatgctttttgaactgcattttgcagaatgcagttgcaatggactgaatgttcatgtcctctaaaaattcatatgttgacattctaactcccaggatgatggtattaggaggtgaaactttgggaggtgattagatcatgcaggcagagtcctcttgaatggaattggtgccctcataaaagaggcctcagggagctagctcaccccttctaccatgtgaggacacagtgacaagttgccatctgtgaaccaggaagcaagtcctcaccagacgccaatctgctattgccttggtcgtggacttgccagcttccagaactgtgaaatataaaattctgttgtttataggccacctagttgcaagtattttgttacagccaccctgacacactgacagaggtatttcatgggtctcattagaaaatggatgaaaaaagagctaagtcaaagtttttacccccacgctatcttagtcagaattgctctgttttcatattttacgtgtggctattctctgtaaaatttgtttgaaaagaagttcaactgctaagaagaaaaaacatatttgaacagccctgctttatataataggtaagtgattgaacatgtggatatatttctctgtgcactgggaacacatagggaaatcatttgaaagaatattgctgcattctttgtaaaatcaatacctgtggattttcatgagtctgaaataattaagagtgtgtaggatgaacagcccttaagggtagtgttggggagcgggtggggcggatctggggaaggacattgtattgtttcgctgactgttttatgtcttagcaacaagacataacttagtacagcatcagagtccctcaggattacaaattacttgagggcagaaactcttttctgtagctccttcagctccctgtcgtgattctttaaatatttcatgtgcaaatgagtcaataaatggtaggaaggcagatagagcaggaaaattcttttccttcctattaactcttgtcccctactctttaaactcactgggctcggctctagacaatcaggtcaagtttatctttggcaccctttgctttagcaggcattccttttttccgagtgcccagtgtatcctcttacccagggttatttcactctcaaatcccagaaagggctatcttcccatatagtatctcatgcctcagacctttcctaatcctctaggagaggctctaggacctctaggcttccttgttatgagttctacttcttgctctctgtaaaaattttacagagttagcatcaggccacttagaggatgaagattacagagaagagagccttcaaactcttgtctctgcatgcaactggaatagaacactgcccaccatcgctcattgtatctaagcacttaaccccacccatgttgaacaacacttacctacctcccgagaccttttttcctcgaaggacagttttgtgtgatcccaggctcatttatttttaagggcaggtaagttacaaaaacatagggcatccttttcttgggttatcatatctcccactcctcatggctcaaagttactgtccttcaaatcgatatattgaaaaaagcatgagccactgccagagcagtcatttctctcccagtgtgtggttatcctggcctactttggctcacaggagtgaaggaaacaagctgcttgtttaaattatggagaatcaggctgggcatggtggctcacacctgtaatctcagcactttgggaagccgaggcaggtggatcacgtgacgtcaggagattgagaccagactggccaatggggtaaaaccctgtctctactaaaaatacaaaaattagttgggtggtagcacatgcctgtaatcccagctacttgggagactaaggtaggagaatcacttgaacccaggaggtggaggttgcagtgagccgagatcgtgccattgcactccagcctgggcaacaagagcaaaactgcgtctcaaaaaaaaaaaaaaaatatggagaatcagtactaaggagttactcctttagtttttcaaacaaatggtcatcatgtgcctgctatatactatacctattaacccactgtggtagattctgatataattaacttcttaatgtatcattttgttttctgtttactccttcagcaaaattctttagggaaacttatgtaactggttcagtaacaaaagcaaacaacactcaaacatacttaaaactcatgtagcttttaaaccactatctacaaatattttcagttttaaggcaaaaacaacttgagtaccaggtatgactacaaaataaagtgattattatcttttaacaacaaacataatagggtgtactcactcaaagatataatctcccctttaatgtagccaccatgagagtccatgcctttgttctattggtgtggcaacaactgcttgtcttttgggactaaaattagacattacttccttctttcaggaagctggccctcactcctaaagctgggtttcatgcccctcttctgggctcctgtgcttgcgtcagtcaaagcacttgtcatactggattatctttctccttcacctggctgagtgctccctgaagatagggaggatgtcttctgtggtttttgtacccctggggccaagcatgtacaggactagttgctcagtaaatatttgttagttgattgaaaaatatctctgcatcacatttttggaccatcttcaacaacagaaaattttcattcttttaatggagaatgatttttggaaaacaaatgttattcagaaacaagttgggcacataaggtattcatctagcttatttaaaaatgagttatgatcataatatattgaccacttttcttctctgattcatagactggctctgagaacaactccaaaggaggaattacaaaaggttctgaacaatagaagcttcccagggcaacatctt[144 bp omitted]gcctcccgagtagctaattttttgtatttttagtagagactgggcttcaccatgttagccaggatggtctcaatctcctgacctcataatccgcccgcctccgcctcccaaagtgctgggattacaggagtgagccaccgcacccggccagggcaacatctttgaaggactacattcatttatatgtttaagttacaacatgtgtctggagaatagtcaaataaatatttgccatgataattattgaatacatactctaggcagcagagcatacctttagaggttaagagcattactctggagctggactgcttgggttcaagtcctggctgtgcaatttatttagctgtatagccttggacaagttactcaaccagtgggtacctctgtttcctcatttgtaaaatgtagattaaacagtacttccctcctaagatcgttgtgagattaattgagtcaaccacgtaatatacttagaaatagggcctggtatatagaaagtgttcagtataggttattattgttatcatcattacatttatcattattactatgtttgaggtactgtgttagtaatactaaagatttaaaaaaggggctgggtgcagtcacacatgccttaatctcaacagtttggcaggtggagacaggcagattgcttgagctcaggagttcaagaccagactgagcaacataacaaaacccctgtctctacaaaaaatgcaaaaattagtcaggcatggtggcaaacctttaatcccaactacttgggaggctgaggcaggagaatcgcttgagcccaagaggcagaggctgcagtgagccttgattacgccactacactccagcctggcgactctgtctcaaaaaaaaaaaaagttccttccctcagtaagttcacagtcttatgaaaaatatacacatgtgatttatcttataatacaacttgatgagtgcccttagaaaagtcaactgtcattgtggggagggatctagtagtggtaacatctcagtagagttctgtaagtactgaatgccctccactcaattcaaaacagtgtgtcccaggaatatgaatgtcagtatagccagatacctgacattcatgatagtgatagcagcagaaagacctgactaaaattttttttttttttttctgagacggagtctcgctctgttgccaggctggagtacagtggcatcatctgggctcactgcaacctgtgcttccccggttcaagcgattctcctgctttagcctcccaagtagctgggactacaggtgcctgccaccacgcccagctaatttttgtatttgtagtagagacggggtttcaccatgttggccaggatggtctcgatctcttgacctcatgatctgcctgccttggtctcctaaagtgctgggattacaggtgtgaaccaccgcgcctggccccatttgttttttaaacaaagtaatgatatgtgatgttaatgcctgtgaaagtatttaatgtaccacgcatcgctctgaatagaatccattctggacagagaattcatagactctatcattaatatgtctctatcttttaaaaaaaaccaattccactttcaagaacaaagacataatgctgctctgatccttgaagtgaataatctagaagggcttgccactttaccaaaataacttacagctttactgtggattaaaattgaatcaaaatttaagaagagaattatttaataatgacataatctacatttgggaagtatattgtttctttcattactgtgtcatttattttactgtgcagaaaatatttttccttttttttttgaga[132 bp omitted]cacgccaggctaattttttgtatttttagtagagacagggtttcaccatgttagc[154 bp omitted]ttttctctctcagaagtagttatgaagatgacaatatatattgcaatcagctattttgtatgattcatgaagaaacacttcaaaaataactttgtaataaagacagaaaactgtttcttcacgattgtgattcatcataattatttttgaacatttggtaaatcttatttctgtggacttttttttcttgagacttgggtctcactctgttgccaaggctggagtgcagtagtgcaatcatggttcactacagccttgacctcctgggctcaagggattctcctgcctcagcctcctgagtagcttggaccacagacttgtaccaccatgcctggctattttttaatttttttgtagagatggggtctcgctatgttgcccaggctggtctccaactcttggctttaagccatcctcccacttcagcctcccaaagtactggaattacaggcatgagccactgcaccagactgtgaacttttaagaactttaaaaccctttcagggcttatttcaggccctcctttatgaattctgcaaaggcttcacttggtgaagaaaatggacttgaagtactaagtgtagtatgaaacaatgtggttacatatatgttcctgcacacttttcagtttctcttctgagaagttcaaagaagtcaagggattatttgggggaattaaagtaattgcaaagagaaatagtgtgggccagcaacccttccaaaatgacatgctgtgttctctgggcccaaggggcaagcaggaggtagggtgtttgttgaaagagttctctttcacaagagaagaaggtaaggttactatatcaattctttattttctttttatgagactgagtttcacttttgtcgcccaggctggagtgcaacggagtgatctcagctcactgcaacctccgcctcccgggttcaagcaattctcctgcctcagcctcccgagtagctgggattacaggtgcccgccaccacacctggctaatttttttttttgtatttttagtagagatggggtttcaccatgttggccatgctggtcttgaactcctgacctcaggtgatctgcccgccttggcctcccaaagtgctgggattgcaggcatgagccaccctgcccggccagttactatatcaattcttaagaagaaatctgtagtggagccccagatgtgttttcttctgaaagagaaacagaatatggcaatggtaattggggccatgtactatatttggcatttgttccaggtctacttagttaaactgaattttctgcttaaagtttggaattactattttggaagatgccactctaagttgtacagagcaagtacacagctgtcatctttatttcccctcaacagctattaacagtttatcctaaagtgatggattttattctgctacgtgaatcatgagtagtgtaatcataaagcgtattaatattgtgaggaaactctgcattctgagtatgtacatgattaacaccgtttctggacatgaataatgatgcctagggtttctgacctcacccagaacttcctaaagtttcagaaaatgaaattttcagcaactacaactactataatttctgttgtccttctaatatcaagacttaaaaaaaaatccaagcatgcactttcagtcatgattgctactttaggggtgcctgggtccttttcgtgttg[133 bp omitted]taaaaatatataaaaaaattagccgggcatggtggcagttgcctgtagttccagctactcaggaggccgaggcaggtgaatgccgtgaacccgggaggcagaagttgcagtgagctgaaatcgcgccactgcactccaccctcagcgacagagcaagactccatctcaaaaaaaaaaaaaaaaaaagaaatgccccacctaattctctctaggcaatgctcccacttcccaatcactattcctcctctatggtccctcagacgtaaaatatccaagtgtgggtatttgttccctcaaggccacaactcaatctttttaagcaaaagaagttcctctagaaagttcatgaatcatcacttgaaagtaaaatgttatgcattcggagtgggggtattcaaaggattctttcaattctcgaagagatcagtatcctcccccccaaaaaaattaagaaatatggtactaaggtctaatgcaatgaggttgatgtagtttcatttgaagattatttgtagtttagcagagagctcctggaaagaatgccttaacctaaagaaagaattctacaataaaggaaaagtaggctccagtggtggggaacgtattatttgggagaggattttggagtacttcaccacattgtatgggcaactaattattttttcttgctctgtctctttaatactgatgacaaagggatatctgtcttttatttcgccctgtagttatggtcctaacatatactaggatataatacattttaaaatgttaacacaagtgccaaaatggggtggggaagcattaagtccacttaactttagcaagcacttactgagcacctactatgtataaagcacagtgctaggtgatataggatagaaaggcaaataaaattctataaggtctgaaccttccagaacctgacaatccctaggagggggatagataggtgatataggatagaaagacaaataaaattctataaggtctgaactttccagaacctgacaatccctaggaggggtatagatagacacacacacacacacacacacacacacacacacacacacacacatacacgacagtacacacacatatatatatatatataaataatattaatgtaagacagactatgagatatgctattgcataatatgggagaaggcattgatgctaactagagagcacctaggaagctttaactaaaagtagaaacaaggctaccaaccctcaaatccctggacccttccccttctctgaacaactatcttcaacagattcagagattaggtccactgaactttaattttttctcttttttctttattatgaaatatttcagacctgcaaatggtatataaaaaccattataaatacccatgtgcataaatacccataacttaagcaagaaaatgttacagatatgttctcattgttcaattgccacctatgagtgagaatatgcattgggagatatacctaatgctagatgatgagttagtgggtgcagcgcaccagcatgtcacatgtatacatatgtaactaacctgcacattgtgcacatgtaccctaaaacttaaagtataataataaaaaaaaagaaagaaaatgttacagatatagttgaagtacccacacaactagaattattttactaacatcctctgcttttatttaaaaaaaaagtttttttttttttgagacggagtcttgctctgtcacccaggctggagtgcagtggcgcgatctcggctcactgcaacctccatctcccaggttcaagcaattctcctgc[134 bp omitted]cggcctcccaaagtgctgggattacaggtgtgagctgctgtgccccgccatcctctgcttttactagcagctttgaaagatgaccctcaatgaaccctgtcttctggtattcatgcccttgtgtcatccccctcccccgactgtggctggacttagcgacttgcttctaatgaataaaatatgacaaaagttgtgggatgtcagttctgtaattaggttgcaaaagactttgacttccatcctgccagcactctcactcgttcattctgatgaagcctgctgccacgttgtgagatgctctatggggtggcccacatggcaaggaatcaagggaagcctctagccaacaccttgtgaagaactgagtccttcgtccaacagcccacaaagagccaaatcctgacaacaaccatgtgagtgaacttggaagcagatcctcctggttaagtcttcaggtaagactgaacccctggctgacaccttgattgcagccttggaagaaaccctgaaacaaaagactcagcgaagccatgtctggattatgttttgagctcctgaattttggggtaatttgttaatttgttatgcaatatgaactaatataccttccaagaagtaaccactgtcctaaatgtgctgtttatcattctcatacgtgtgtgtgtgtgtgtatatatatatatatatttgtatgatcattcccatgcatgtgtatatatataaattgattaaatgtttttattccagtctgccatggaagaagcatatataagttgtattaaatgttttaaaaatccatataagtgccattacaatatttgtatccctctggaactagcttttcccttattcatttttctactgccaccactcaatctttgctcttccaagaggtctttctctcacagcccctgtgacttctagtctcctccccagcccagcctttggtgttctattcagtttatgtgcaacagtcccaagccattgaattaagcctggtcataccttaaacgaagctcagcttcttcccatattgctctctaaaccaaaatctgggcctaggctctttaatattacatgggcttctaggcttatctggatcatcactttggttttctttgataatgctgctttccatagcagtgtgcatgttaaagtttaagtgtacaggaattacttgtggatcttgttaaagtgcgattgtgattcactaggtgtgcagagggcctgagactctgcatttccaaaacactttcaggtgttgctgatgctgctgatacgtggaccacatatttagtagcaaggttctagaagatagacatccatctctgtctttgcagaaattgttttaacttggtattttaatttatatagttcagcaataaaggaacttaacataagcttacccaatgattgaatgtgatagctttcaaagaagggaaggtaggccaaaacaaaaacaaataatgtaaggaaacattttactcagtgttatttacctaaagcaagtgaaaagaagagaaaaattagagtgaaaattaacagactagataatagaaaaacaatagagaaaaatcactgaaactaaaagctgcttcttggaaaaaaattaacaaaattgtcaaacctttagctacattgaccaagaagaaaagagagaagactcaaattactgttaccaaaacacccgaggtttggtctagatcctgctgctcctggcacagaaagccagtcactgagacaatgagtattgccaaggaagaaggctttaatggagtgggggtgaggggtgctgcagttgaggagttgggagatgagtctcaattccatcttcctggctgactaatattaggggtttatttagtggggaagaaatgtaactgtgtgggaaatcaggaactagggaggggtaaggaagcaatcatgaggaatgaggggtctggcacttcattgtctggatatggtgatctgttgagtttcagttcttcgatactttttgagaggcctggggatcttttcctgaggaaggaacgcaaatgaaacaaatggaagtttcaagctttaagaacagaagggtcaatttctatgtttatccacaaaaactgtctctgggactattgggttggtttcattgatagaattagaaattaaagagggaacattactactgactttacagaaataaaatggattataaagaaatactattaacaactggacatcaataattagataaaatgaaaaaattcctagaaagatgaaaactactgaaactgactcaagaagaaaaaactaatatcaatatacctatcgcaagtgaacagattgaattagtaattttaaaaaactacccacaaagaaaactctaggcccagatagttcaacactgagttctaacaaacatttaaagaagagttaatttagcctggcgcagtggctcacacctgtaatcccagcactttgggaagccaa[131 bp omitted]cgaggcgggcgatcatgaagtcaggagatcaatatcatcctggctaacacggtgaaaccccatctctactaaaaatataaaaaaaaattagctgggcgtggtagcgggcgcctatagtcacagacactcaggaggctgaggccagagaatggtgtcaacctgggaagtggagcttgcagtgagccgagatggcaccactgcactctagtctgggcgacacagtgagactccatctcaaaaatataaataaataaaataaaataaaataaaataaaaattagctgggcatggtggcaggctcctgtaagcctgtaatcccagctagtcgggaggctgaggcaggagaatcgcttgaacccgggaggcagaggttgcagtgagccgagatcctgccactgcactgcagcccgggagacagtgctagactccctctcaaaaaaaaaaaagttaatttaacaccagttcatcacaaagtatcccaaaatagacgatgatggaactcttcccaactcattctgtgagaccaatattaccttgataccaaaatcagataaagatatcacaggaaaagaatactaaagatcagtaacttttatgaatatggatgcaaaaatccaaaacaaaatactagaaagctgaaaccaacaacgcaaagaaaacaatgcagtatgaaaagtgggatttggctgggcacaatggctcacgcctgtaatctcagcactgtgggcggctgaggcgggcagatcacctgaggtcaggagttcgagaccagcctgtccaacatggtgaaatgtactaaaaatacaaaatgtactataaatacaaaaattagctggtcgtgttggcgcgcacctgtagtcccagctacttgggaggctgaggcaggagaagcacttgaacctgggaggcagaggttgcagtaagctgagatcacatcactgccctccagtctaggtagcagagtgagactctgtctcaaaaaaaaaaaaaaagaagaaagaaagaaaagtgggatttatcctcggaatataaagttggtttaacatctgaaaatcaatataccatagcaattgaataaaaactaaaattcacatgatcacctcaatagatgcagaaaaagcatttgacaggctgggtgcggtggctcacacgtgtaatcccagcactttgggaggccaaggcaggtggatcacttgaggtcaggagtttgagaccagcctgatgaacatagtgaaaccctgtctctactaaaaaatacaaaaattagccaggcgtggtggtgggcgcctgtaatccaagctactcaggaggctgaggcaggagaattgctcgaacccgggaggcggaggctgcagtgagcctgccactgcagcactccagcctgggtgacagagtgaaactccataaaaaaaaaatagcatttgacaaaatccaatacccaattctctttcatgataacaatattcaacaaactagcaacagtagggaactccctcaacttgataaagggcaactaggaaaaatcacagctgacactatacttaatgatgaaagaatgaatgacttactcttaagattaggaacaaaacaaggatgtcagcatctcaacattgtattgggagttctattcagggcaattaggcaagaaaaagaaatacaagccacctagactggaaaagaaaaaagtaaaagtatctgtgtttgcagataacacgatcttgtatgtagaaaatcccaaggaatccacaaaaaaaaaggtcaatcaaggttgcaggatataagatcaatatataaaaatcaactgtttatctatatacttgcaataaacaataaaaaatgagattaaggaaaacaattccatttacaatatcatcaaaaagaataaaatacttaggaataaatttaagaaaaggagtacgaaaattatgctgtgaaaactacaaggcaatgttgaaagaaattaaagaaggtataaataaatggaaacacattctatgttcataggtcaggagacttaatattgttaaaatggtaatacttcccaaagtaatcaacatattcaatgcaatctttataagatcccagctagtttttctttagaaattggcaagatggctgggtgcagtggctaacacctgtaatcccagaactttgggaggctgaggcgggtagatcagaaggtcaagagattgagaccatcctggccaacatggtgaaagcccgtctctactaaaaatacaaaaattagctgggcgtggcgttgtgtgcctgtaatcgcagctactcgggaggctgaggcaggagaatcgcttgaacctgggaggcggaggttgcagtgagccaagtttgcaccactgcactccagcctggtgacagagcgagactccgtcaaaaaaaaaaaaaaaagaagaagaagaaagaaagaatgaatttggcaagctgattccaaaattcatatggaattgcaagtgacccagaatacttaaaacaatctggaaaaagaagaacaaagtagaaggactcacatttcctgatttcaaattttacaacaaacggtaatcaagacagtgcagtagtggtataaggatatatggcatagaattgaaagtccagaaataaaaccatgtgtctatggtcaactgattttgacaagagtgtcaagaccattcaatgagaaaagaatagtgttttcaacaaatagtgctgggacaactgcatagccacacagaaaagaatgacgttggatcatgccccacactatatataaaaatgaactcaaatggatcaaaaacctaaatatggccgggtgcggtggctcatgcctgtaatcccagcactttgggaggccaagaagggtgaatcacctgaggtcaagagtttgagaccagcctggccaacatggtgaaaccccgtctctactaaaattacaaaaattagccgggtatggtggtgggcgcctgtaattccagctacccaggaggctgaggcaggagaatcgcttgaacccgggaggtgcaggttgcagtgagccgagacgttttcattgcactctagcctgggcaacaaagagcaaaactccgtaaaaaacaaacaaacaacaacaaaaaaaccccataagattaaatgttcatgacctcagctttggcaaggaattgttatttatgataccaaaaggacaagcaacaaaataaaaaatagataaatttgatctcttcaaaatgtaaaacaaggacaccatcatgaaagtgaaaagtcaacccacagaatgggggaaatattttcagttcattaataagggagtggtatctagactatataaaaacccaataataaaaagaaaaaccaattaaaaatgggcaaaggatctgaatagacatttctttggggaagaagtacaaatggacaataaacacatgaaaagttgctcaacatcatcagggagatgcaaggcaaaattacaatgagacaccacttcatacccatgaggatgactataattaaaaagtcagataacaagtatgggcaaggatgtggagaaattagaatcgtcctacattgctgacaggaaggttaaatgatgcagccactttggaagacagtctggcagttcgtgaaaagtttaaacagaaagttgtcatatgaaccagcaattccccttctaggtatatacccaagagtaaggaaaatatatgtccacacaaaaacttatacagaaattgtacaggagtgtttatagcagcatccttcataataaccaaaaggtgaaaacaacacaaatgtccatcaactgatgaatgaatagacacaatgtggtatctccatacagtggtatattatttggccataaaaagaatgaagtacttactgatacatgctacgacatggataaaccttgaaaacattacatggagtaaaagaacccagatacaaaaaccacatattgtatgattccattaatttgaaagtccagaatagggaaatctaaacagacagaaagtagattgttgctcagggctgaagggaatagggaataaaacagcgatagccaaagggcatgggatttccttttgaggtgatgaaaatgttccaaaattggtaatggttgcagtatctgtgaatatactaaaaccactgaattctacattttaagtgggtgaattgtatggtatgtgagttatagcacaataaagctgttaaaaaaaataacctgggacattcatagggctcaccttgtttatttcccatcttcctgggatcaccatccttagttacctactattaatatctagtgacttgaaaacttgcttcatgttgtctgtctttatttgattttatttggttgtttcattcaggagggtaactacaaaccctgttgctccatcttagccagaagtggaagtctccctatttcttaactggagaaactgagtcagctaactggcttgccaaagttcacatcagtcaggactataaccaatatttcctgacttctaatctgcagttgagacagaattgtttcttggctaacttccaggacaacttgatagcagaaagtcgattaatccggcatagaaaaaggaaatatgtgtgacttgacaatccctggaaggttcagatcagttatctgccttcccctcaatcaagcaagtatttgccacatacctatgcacaatgtcttttgggagacactgccgggaatagagaagtcagtgctagcatctctggcaacagggggatcaccatctatttgggagaaaaagctacacatgaaacatctctgtgactcaaatgactcaaccatgtttacctataatataatgacttactcaactatgcagtcaagagagtcaggaaaggtcacagtgtgtggccttttctcaagaaaggcttcccagaggaggagggacttgggcttcaaaagataggcagcatactctgtctgggtagggcagtaaaggcaggacattgtctccacaggacttatgtcaaaatgcacgaggcctcagagggttcttggctgtaaaaaacaaacaaacaaaaaaaaaaaaaacttgagccttgtggtaaggaggaaggaaggggatattgtcctgtccagaggacagacctagaggacagtcctagaagatttaatggaagttctatggtgaggaggatgacgaataaggcatctttatgcctaccgcaaaatcaaatcctcctaggtagacagttttcattgaaagcaaaaagtgtcttcccaggtcatgaagagcagggctgtccactcgaagctgcaggacaaacactctagactctactcattcaatcatgcagtgaacatgtattgagcatctactatacgcctgaagttgtgttaggggctggggactcacagttgcctaagacttgtggcttgccccagtttagtctagatgagaagacagacatttggatgatgatgacaattttccttagggaaaggtgctctctttccccaccctactccctctgtcagtcaacagaagtggccaagtcctttccatttgcagaccaacatcagggtcagggtgggacagagggagagacctaaagccacaacaacccacagaggtttccacttaatgttgggataacaggcaacacccctggaagaccagcccaaagatctactttacagcctgtctcaaaactcagggcctccaggcagcctacttttctatatctgccccctaccaccctcaccagaggccatcctgaatgacagtgatatgtgtggatatggtttagctcccctaagaaaggccctttagggggaacgcccaggcctgcctcaagtttgtaacacccacggagcctgccacagggctctgcaccaggtcagtgtttggtaaatgcttgctgaatgactcaaagggctttggaatcactatcaccatgaatggtgtttctcttctacctgcctagggcttgactgtctacaaagggccttgctatcccctcttcctttttcttaggatcatttccctggcctcacttgaggtttctgctcttccggcctagtgtgattctgctgtgaggctggggacaatgagggatctcacccctcaggggagaccctgcgcccgccccccacatacagggagtgacttggtcccttgctggcctcctagtctactgtgtcacagccaaagcaggctgtgggcactctccaaagagaaacaccagtgcaggagtgccatctccctccaggtggggtagggcccctggtcctcaagcccagtgcttcctgctgctcctggaagccacgggaggggtgggggacagtgtggaatgctggtctctcttgggatttgaccttcactcccacatcccatgggggtcactgcacaggctctgtgaccttgagctcagcccctgggagtggagttgcctgtcagggctccatccttcctgttgagcaggaactgcagccccactgggccctgattctgggcaagtctgcaccaccacaggctccttttcacttacaggctaacctagcttgtgggattcgaagaaagattattatcattaataccctctgtgtgtgcagggccttgccattcacagcaacacttcttcatcatcttattgatgtctcaggataggcatatcagttgggtttttcataaactgtaatttcatctccttcctcagtcattttttcccttcctactggttttctaactcagtgagtggccctccccctccaaaagtatattagcagtacaagtgtctcagaaaaaaacaaacatacccatgtatcttggttgacactttgagtctgataacaccatgctcagcaattacagggcagggacacactccctggtgagcaaacagtagagttcagggaaaatcgctatcaagtataagtgtattatgaggtcagagaccaatttaccaaatagattgatgacagagttgctattcacagtttgaaagtgcagttattttaaaagacattcataaagttattgaatttgagtgagtatgcacttgtgtattctattcccctgggttttctgatacaagtttataaaaagaaagtgactagttacatcccacagctaattagtggtctgggctaggacgcaagcccatttttctttcctgagccttggcctgtttatatgagcctccctggaatggaagcgtttgcttacaggctgcccattaaatgctaaaagtaaaatagaagataaaagagtgacttgaagctcaagtattccaaaacatagtacactgatgaccagttcaacatttagataaagtactatagctctgaaatgaatatttgcttcatagcagtcaatggggaaatgggacttgaattccttgaagtggctttacatacaaagatctagcaacccatctaacagcatcttctgaagaagtgaacaaaagatgtcaaggtggaaagccagggtcctgaccaaattctttaggctgtgagacctcgtacaaatcacttagcctaggatcctcaacttccattgatgttaatatctaagttactaccaaagagaatcaattgaggtcatccagtcagtctccacatctgctctgtcttatccctaaattcctcttttctccatcctctgttctctccttagctgagtcctcttcattttgctctctacactgtagccaaagagatcttttgaaaaggcaaacccagttacgtagctcatctgctcaaaacccttcaataggtctctgttattatcataataaaaatcccaattccttaccctggtctacaaggcctttcatgatctggcacctgctggtttctctggactcatcccacactactactccctcttaaatcctaggctctagccataattaacagctgttcctgagtaagccagcttctctcacctccagcctttgcactagcttcttcttgttcccagaacactcagtgccttccagctcccactcccccttttcttcttctaaccctgtaatattctgtatctatattacccacctgggaaaccctcccccagtctgaactgctcttcctctgtgtctcccccgtcacacccccgcagcaccctatgcttctgtcttcttaacactcctcagcctgattaaacggcctttttttccttgttgatttctcccactcacttctgcaggactgtgtcttactcatcattatgtccccagtggagctcgttgaatgaatgatgcatgtttaaatgctttgtaaactgcaacttgctacacaagtgttaagtattatgtaacgttattgtgttcagattgcttgcttagttattgttggcatactcacccatttgataataaagaatataatatttcaagcacattattttggctccttcttaagcccaatagtaataaaggctaccacttattgagcacttaacctggtctaggctctgcagtaagattttacatgtacaatctcatttacttatcattatagcaatcttataagcaaggttctattatgagcgtcatccctatttttcagatgaaaacacagcttgcccaatgttacacagccagattttgaatccagatttttcaagttcaagatccatgccctgccaaagtcttcatataagagaactatcaacagagtgaaaagacaactcacagaatgggagaaaatatttgcaaatcacatagccagtaagggatcaatatccagaatatatagagaactcctaaaactca[277 bp omitted]ggcctcccaaaacactgggattacaggcgtgagccaccgcgcccggccagcaattgttttcttaaaaaaacaaactgattaaaaaatgggaaaaggcttgaatagtcctttctccaaagatgatatgaaaatggcaaaaaagcacatgaaaagatgtttaacatcactaatcattagggagatgcaaatcaaaaccacaatgagatattactcacactcattatgatggctactattaaaaaaaaacaaaacagaaaacaaaaagaattggccagcatatggagaaattggaacccttacgcattgctggtgggaatgcagaatagtgcagcctctgtagaaagcagtgtgttggttcctcaaaaaataaaaagtaaaaaaaatagaaggacagtgtgaaccagcaattccattgctgggtatatacccaaaagaattaaaatcagggtctcaaagacatatttgtatacccatgttcatagcagcagtattcacaataaccagaaagcagaagtaacctgtgtccatcaacagacgaattaataaacaaatgtgagatttacgtgcaatggaatattattcagccttaaaaaggaaggaaattcttgcggccgggtgacacggttcatgcctgtaatcctagcactttgggaggccaaggcaggcagattggctgagctcaggagttcgagactagtctgggcaacacggtgaaactccgtctctactaaaaaatacaaaaaataagccaggcatggcagtgtgcacctgtaaacccagctactcgggaggctaaggcaggagaatggcttaaacccaggaagcgaaagttgcagtgaactgaggttgcgccattgcactccagactgggcgatagagcgagactccgtctccaaaataaaaaggaaggaaattctcatatgctacaacatggatgaaccttgaggacattatgctaagtgaaataagccagttggaaaaagacacatattgtatgaatcttcttctttgagctgcttagagtagtccaattgatagagacagaaagtagaatggtgacttaccaggggattggcagaaaacagaatggggaattaatgttgaacgggtatagaattttggttttacaagatgaaaaaagttctggagatggatgaatgatgacgatggttgcacaacaatgtgaatgtatttaatgccactgatcatgcacttaaaagtggttaaatgataaattttatgttatgtatattttactacaatttaataaaaagatccaagccctgattctaaccatttctcagtcctgccaaagccttcagataatttgctcctgatgaatgtttgctgctttccctccagataacctgccttttgtttctttttcctcccatgaccagactgctctgtctggtcctctagagcctccacattggtgagtgtctctgaagagggcagggcccaggctcaagcctcctgcccactctcctcttgggaagaaaatgcttactctgagagcagccagcgcaaattttactcataacaattaacagatggctgtgcatcccttctgttcccaggaatcacatctcacatcgggactaactgcactgtgcattttccatcactggtaactaattccaacagtgacgctgggcattgttattcatcggtgaagaacagacataaagagagaggggaagtggcttgggctgagtcacatagcaaagttagaactccaacctcccagcaactaaccttgccctgggctctgtcccacacacctggcagctcaagacttgctcctttttgcactctgggcgacagactccctggctaaccaagcgcgtctaacttgtcttgcagagaaattaagcgaaatcttccttgggatagtatcttgccatctttcttttcttagtggttgacaggccagtatctccactactgctgaatgaccttgtgcacatcattgaaagtctctggactctcagtttacccttcagtaaaatgtagggaagaattattaatgccactaccaggggaactgaggatgaggtagggagggaagaatcggggtaaactcctccagtgtattctgcatcatcctttacatgggtgaacatcaaatttaactga[139 bp omitted]catggcaaaacctcgtctctactaaaaatacaaaaattagccgggtgtggtggtgcatgcctgtaatcccagctactcgggaggctgaggcaggagaatcgcttgaacctgggacacagaggttgcagtgagctgagatcctgtcactgcacttgaccagtccagcttacttggaattctctttttcctgggccacctatcccccaatataaaggaagtcccctggtattgagccgcaggatggtctcacttctctatttaaatcctctccaacctagcttaaaagcaccttttccatgagactgcattgcagtctgtcccctttgagggcttccgtggacacactgttcccttaattttggcacttcttacagactgcctgttattttttaaatctttgtctcttgtttcctcagttagctactagaggataaggactgtgtcacatcctattattgccctacaaatgccaactccattagcacatagtatatgctcgataaatatttgctgaactgatgaaaatcttgtaggtgggaaatctgaaataatttcttacaataagtaataagaaggagatacgggagttcgaaaccagcctgaccagcatggagaaatcttgtctctactaaaataatacaaaatcagctgggcgcggtggcacatgcttgtaatcccagctactcaggaggctgaggcaggagaatcacttgaatccagtaggcgcagtttgcagtgagccaagatcacgacattgcactccagcctgagcaacaggagcgaaactctgtctcaaaaaaaaaaaaaaagaaggagatgttctgtgctctttagctttctgatcatatgaaaaaaaaaattttataaacaaagagatatgagccctagcttccaatttggctgtatcaaattcattatgacctgtggcaagtcacttgccttctctagtgttcagtggcctcatttgtgaaaccagagctgatgtgtaagctaactttccttccttccttccttccttttctttcctttttttttttttttttttttttttgaaacagagtcttgctttgtcgcccaggctggagtgcaatggtgcgatcttggctcactgtaacctccacttcctgggttcaagcaattctcctgcctgagactcctcagtagctgggattacaggcacgcgccaccactcccgctaatttatttttttaattcttagtagagatgggggttcaccatgttggtcaggttggtcctgaactcctggcctcaagtgatccacccacctcggcctcccaaagttctgggattacaggcgtgagccaccatgcccggctaaactttcttttagttgtgggttttggctactctgtatagcaaggagcggtcttgctttccatatcaataccattaatgtccatggttcctttttttccccctgtaaggactgcagatttatgggtcaccccagtttataaaatgagaatatcagatacagaacaaatgtgtgctttggccaagcttccaggcatagagtgtgtgcatgtgtatgtgtgtgcggggttgcttacaccttactacaggtctctggcttcgaatggactctttcgtcccagagttgctcagcaggcctttccaagtacaggactgtcaaccatttgttgtttgtgtgcccagtctctgctttgtgaatgaccacagtgcatggcattccaactgtttcctcttgtccctctgcacactcctagggccagaatgtccactggcatgttcagtaagatctgttcaagcactgtcctgcttatgtcactggaggagatataagacaccagtccttgccctctgaagcttctagcctacatgggaagccagtacaaggatgtgtgtatgtggggaaagatgcactatcataagtgagggagagcctgggagttatgtgctgcttttttttttttttttttttgacagagtctctcactctgtcgcccagactggagtgcagtggcgtgatcttggctcactgcaacctctgcttcctggcttcaaaccgttctcctgcctcagacttc[133 bp omitted]agccatcacacccggctgctgctttgatgtgtctccagtatctagaacagtccttggtatgtggaagatgcccaacaaatatatgaaaatgtgtgaaaattgctatggttttcaaacttgatattgtaagggacagcttttcttcaaagaaatcatacctggaggctcagttatgtgaaacagatggatacaatactgccctgcttgaggggagctagggtcaaagcctgtctgcttgtctcctctgagccccaaagagattcttgagagtccagttggaaaactactagttgaaaatgaggggcagctcaatccttgctctctcttcttggttaaccttagccacaaggtgatcctagcaaaataaatggaggtttaaagaaccttacactccaaagggaatatttgcacctgaaaaagatggtgttaatctcccccttcccctcattccaggggggctccaattagtaagagcagagggaaggaaattctgagtaggagacttctgaattggttcaacaatgtctatcaatgtaatggtaatatttgtttaacttaaacaaacaaagaaagaaaaccactgtgataatgtttttcagcattcaatagaaacccacttggtgttgtcctacaggcagtcttgattacaatgtaaaactccctgtggagtctggtcagtgagtagctggtactgccatttacaccagagtacctcgcattatccagactgctattcacattcctgaccaagttcacggtcaacctcctgcactggcagccaagagggcctgcctggagagagcttctcttctccatgcctgcaggactgtgactctctacctgacctggccctctcttagccttcctaccataacagggcaagggaggggaatcaacccaggggatattcccttgtcaaggtcatccacggagcaaagcacatcccagatttgcatctaggaaacaattttgggtaacagacatatatatatatattttagatatgtcaaaggggtaaagctcttgaattaagatggtttcatcattatctatctcatgaatctctaccttccccaacgactgtccttcctcacagatgcctgaaggggcaggcagataattagtgctggggacctcatttgatagtaggggaaactgagaggtgaaaagagctcccttcagttagatagcaactcaccaggaactccagtttctcccctactgcttggtatggccacctcctccacctcttagccagtcctccgacttctacatcttaaaaatctagctcaggggccaggcgcggtggctcacacctgtaattccagcactttgggaggctgaggc[132 bp omitted]gaggcaggagaatcacttgaacctgggaggcggaggttgtggtgagctgagatcgttccattgcactccagcctgggcaacaatagccaaactccatctcaaaaaaaaaaaaaaaatctagctcaggtctgaccccgactaaatggacaatcttccattgatttcccatcccctcaaccccggttcaagccaccatccacagcatttggactagtcatttgtacttaagtaactgagttagtatcatgaaatttggtcttaggatcaaagccactcaaggttagagctggagggaaccttggagattaagagaaactaaggtttggagaacctacctaaggtttcatagcaaatatgtgacaaatccaaggcttcaagccaagttttccaatgtgtccctcgtgctttcctgactacatctggagtttctctatttcttcttctccttctccttcttcttcattttttttttttttcgtgtgtgtgtcttttttcccctatgtgatgcttcctttctgccctgtgaccctctccctctgtcctgtcttattagaaagaggctctagagctggctgcatagtacctgttctctgggaccttggtgttgatctaagactggtttaactacctaaagagaagcagagacccgagggggcctgccataacccaactctgaaacatgacttaatcccaagtaagatcagctctaacatttgttcagaagcaaaaatgatggattctaaagtttgacttccccaaggtcatctggctaagaggtggctgcagcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcatatgtgctgggctttgtagacaaaggtgttactaatgtcatcagtcattcccacctggaaaagtaacttggatttgtcttcttggtggttcagataggggtcacatctgcccacctctctctccttcctacctggcctgttttcttgttggtaatactgcactcataaaccaggctgccggacactagccgtgtgtagccacatctcgcctatgtcaaagtgtctaatgcaccactgacaccacggggcctctaatgaaccacttgtgagcgggggcaaaaatgactttgcagttggggaacctcaggcccagagtggctgggggtatagaaggcaggacaatattaggactagaaatagagcctaacccttttgatctccagtagaaaagtcctagaaaacttatcatttgctcaagatccatactcatacaggacttaacacctgcttgcgctgggggccattaataaaggtttttctttcttattttgacagctccaaatgaccacttgctttatagcaatcggtctcagatttatttcaccttggagtctcatgagaatgcactgcatgatgcagaaatagcatgtaagctccgcccgatgggttttaaggtgagtgtgggatggaagaggtgggaaggggttgtactgtagacaggtattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtacttagaacagtgtctggcatgtagcactatataaacgttctctttcttcccttccttccttccttccttcctttctctctctctctctttctgttttctttcttttttttttttttttttttgagacagagtttccctctcgcacccaggctggagtgcagtggcgcaatctcggctcactgcaacctccgcctcctgggttcacgccattctcctgcctcagcctcctgagtagttgggactacaggcgcccgccaccac[187 bp omitted]gtgcagtggcgtgatctcagctcactgcaacctccgtctcccaggttcaagtgagtctcccaccttagcctcccgagtagctgggatcacaggcgtgtgccaccatgcccggctaattttttgtatttttagtagtgacggggttttgccatgttggctggtctcaaactcctggcctcaagcaatccacttgcctcagtctcccaaaatgctgggattacaggtgtgagccaccgtgtccagcctatataaatgttttctatcgccatttttatcattttccagggacattagaaagaggaaggtgagagtggtgttgctgccctggtgctcctgaacctctactgataggctccttggcagcttggccagttttctctgaagggatcctcacactcacacaatggttgtgccatttcaagtccttaatatagtcagtcagcctgccagtatccccaaggatttaggtcacatggggggtgagaagaaaaacggcctggacacctctcaggatgccaggatgcaaagtgtcactttctgtatctttgcctggcttcaggactggccctcagccacatgtcagtactttgtttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttccttccaggcacatttcagaaaagcccaagccttagccaccctaggcaaggtggaggaggcactaagggagtttctctactgtgtatcccttgatggaaagaacaagagagcaagatgtgaagcccaaagagtgagttgaaatgacatcaggtccagctgcctactggaccctcccctctctgtcttatctaggaaggggagtgagggtgctgtcctccttggcatttggggtcctgagtgggtggttccctgggttaaggggacaaaagggagatgggagtgttaattgattgcccagaaacaccgtccttctggtgtgtacgatcagtttgggcagtttctacatttttgtaggagcctgtgaggaatgttcttgcttctttgactcagggtctggattgtcagtgggagaaaaaccaaaatcaagtacattaatatggggattgaggctcactgaggacattctggctgttgatgagagatccagggcatggggctacctgctgttacataacttttctttggctgaatcacagttttcaccagccacacatgacagccagcccctgggaagggacgttggtggtccccacctcccctatcaccatacacagaactccaaccttcagctcctttgctagaaataaaacacactgcctcacaaatgctagtcagagaccattacaatataatgcaagcagtcgttccaactcttgggtcccagcagaatgtggtagttataaaagaaaaatggtgtgaaatactgagagcattagtgaaggctcagccatcttcaattcatggactttgttgcttattgttctacagtttactctgctggtgtctgggtaatcggcctgtaagttggattctgacagttggcggttgtctctgctctccttgtgccccacccactattcaccgcggagccttacggtttctgtcccagtgtggtttggcagagcagtggataaagaaagtgagcaagagacagaactggtttctgaaggctctagaaaggaatagttagcaaaatcaatgaaataagggaactggccctggattttctgtctcacaaaagatctcctttctgggaagttgctttgaattggtttgagtatgtgaaaaaggtgtgcttgagaggagcacggttcggggagaattgcttcaagctgtggacccttctccaaatcttaagtgtagtccatgatgtaatgataataataatagctaacattcgttgagaatttcttctgcattatacactgtgctaggcattttatgtggagtatattatttaaatcccactacattcctgaggctaggtttggttagttatcctcaggttacaggtgagacagatgaagctggggcttgctgactttcccaaggtcatgcagctggtgattggtgggaaagtattcaaacccaagtctatctgcttccaaagcctggcctcttagctgctctgccatcctgcttcccatgaggacatggccacagccttagcactcactggtgaagctggatcaatagtagcaatggaactttccagttccaggatgaacaaaggcagttagaagaaacttatctttggggacggagcgtgcaaaggccagcagaggcaggtctcagacccaaggaggaatggtttcttgactcttgtttgtccatttcccagctagcctgagatgtttttggtgtcatcagttgggctgacctgtctctccagtctgcttttatagagaaactgttgtcatttccacagctgcctaatggttggaggcaaggcattgtgtgaagctctggagacccaaagaggcataagtcacagttttagtcttcaaggaacttaacaatcttgcatttgttaacataaatgccagatgatgcaagcgagtgtatgcccgtgatgagtgttacagagttctgaagtgagggcgagaatttagaggcgaatttccactgggtgtgatgaggccatggcggcgattcagaacatcaagagtcctcagttgtgtttatttactagatcattccagtttcagggctaaagatttgacagagatgatgcaggttcagttgacatttataagctgccttcgaactcacaggctgtgtttctttttaatgtttgtttttactgcagattctttttccctcttcttgacctatttgggcctttctaaggctgaggctgaagtggaattgactttcattcatgtggaatgatcattctcactgagaattgaccccaacttttgttttccaatgccattgagaaggcctagagagagatctcaagtagtaaaatgaagaagggaactgctgttattatttctgctttgtttcctttgatttctcccttggccttcttttccttcccaccaccctctgccctttcatccttgcaccttgtgatgctgtgtggctgccactgaagagtattatgctctttttgggagaattccaaggatactgcctcctcagaactggcttggtcctgttgagtcacgcattagggcttcagaggaccaaccttggctcctgtggaggagggacctctgaaagctggcatttatggccccgggtgctgtgagtacctccccatttaactcctgtgccaactcataactggaaagtgggtttctcagagctgaaaggaaacataaggatcaatctgaggactttgggcctgaatgctaggcctctccctgggccctggggtggataagtgtcttaattcaattccatccagtgtgatgagcatttattgggtatctgttatgtgccctctagaagctggccgtctggcaggagagaaaggcttacatctgtgacacatttctaggataacataacgtggtgttgttcaagatgctatattatggtgcactctctactactgtgtagaacaggactggaatagtgagggaaggtagcacttgagctgagctttgaaggctgagtggggtttggcttcatggcaagtgctggcatctgaaggaacatcatgaagagattgctgggggccagagaataaatcaaactggagtttggtgttctgtcaaattttgttgatcaattaataccctaactatgtaccctcagcacgggactggagcttcctttagtggatctccaaacactgcaggagctgctgggtggtaagcactggagcaggttttagaagcaaagtcacctgctctccttgtgttacatgtttcagtatatggaaacacacacacacacacacacacacacacacacacacacacacacacacacaatccttgctagtacaggggaaacttggggcaagaatgtggacagtgaatggtgcaagctacattagaacgcacgtctaccctcccagcttatccaattgcaagggaaaccagcaagagactggaacctccttgcgcctagtacttaaacttaacctaacatcctctgggaggcaaaggccagcataggggaggcgaggttgggagaagagggaggaagctggagttctgtttttcctaacagttaactgctcaggttcccagctttgaagggattaaagatccaggggtgatggtggggagaggaggaagcaaaatgggtagtggagaaaagaaacagtgaggatcctagaagacatttgtagacttctacccactgaggtattatgaacttcaaattccccaagtgaggtttctctcctgactttacctctctgtctctttcctcctagatgagttttaaaatcccactgcagatatttctgcggagtgttagcactagcatggtggctcttaaccttggctaggcaacagaggcatctgtagtgccttctcaaaatccagattcctgggccacactccagacctgggggagatgggagtacaaagtagagacctagatttttcataagttccccagttgattctgatgcccgctgaagcgaggacccctgccctggtgtggtgtgttagggacactggtccaaggcttcctccctggagttctgccctgcaagctggctccctccccccttcaccctcctccccttcacctgggcacctgtagaaacttaagtagtgaagtcttctgttttatgtcacagcttctccttagtttcttttcaccatcagtcccgggggattctcaggaacattctcccgatatcctgaagctgttggcacctcaccctagattaaaggaaaacgtagagtcaatgactactgaagttaccagccataatctaccaaggttgttacaggtaaaactcaactcacccagctcgctcgtgacgcttcgtttggctgttttgtgggcaaacgtggggagtgagccctccctctcctattttggttcctgagaaagaagaaattgagtcactagtggttctgttctttgcaaagaacctcttaaagatgcaactgtgaatttcaggcatggtcccagagtttattcattacattgaaaaaaaattatgaaacagggtctctttctatcacccaggctggagggcagtgatatgatcatggctcactgcagcctcagactcctggtctcaagagatcctcccacctcagcctcccgagtagctgggactataggcacgtgccaccatgcctggctaagttttttttttttttttttttttttttttgtagagacggggtttcaccatttttgcctaggctggtctcgaactcctggcctcaagtgatcctcccaccttggccttccaaagtgctaggatacatttttttccagttcttggttagatccagccgagagagattttacagagctagaaaggaattggctcactgcccctgggccataccatttgggtgggtttataggctttggggatgagtctgggaagagggcctaacaatccctcctttcgagcttttgtttgttcaagctgctggcctttgagtgccagcacttatcctgtgcaaagacaactctgatcctcaaatggatgtaatttcatattcctgcactatgccttatacataagtaagcttccaatacgtatttgtaacagagaagaggaaagagatgttggaaagaaagttgagttgaaggacctgggaggaagacaggtatttgtacctttctttgaaaaccaggaaacagaacacaagagagatgggttccaggccctggctttcccggcagagggtaagtggtcagaagttgaggatcagaagcgcagactccaaggcagagtttagcactgaatgcctgggcatctttagggggcagttttccctccattcatgcccggtgttcttctcctgtgtgtaagccctgggctctcataaaaggactgaaatgcaggtgcgcccaacttttcttaaaaaatggcagaacttagaggatctcctgaaatcacagaacccccagtgatttcaataattaagatcactattaaatgattgagaatgctaatactgaacccaaatgcctggagtgacttctaattgcagctccatctgaaaagaagaaaaacagcaaccttggctttccaatgtcaaccagctggggaacaaggattggatttccacccaaactttgctttgcaaagcagtatactcctgagtggccaatgccttgggttcatggaaagtcaaggttgtagtattgctgtagtgctggagaaaaccccaactcccaagttagacacagagaaaacccacattatttttgtcctcacctcattgttttctcccagctatatgctcccctttttcacctgtctgccagtttttttttggtagggttagagggaaacaacacgatgagtatcttgacctatggactatgggtttagattagagaggggttctccatgtaaatctgcataaacatgttgttattgcacttatttctaaatcctttttcaaatatccatctcctgggaaaatattcttgaaaaggctagagacattgttgattttttttgccaggtgattttgtctttttttttttttttaatgcttttcaccccaaatctagtaaaaggaatagtttgtaccttgttcatttgaccagtgtaacatacagacctggagcatgaggtaacttggcaggcctgtgaacagacctgtgccaaagccctaccaaaagtccttttggagctggagtttggggatcgcagacggccgtgaatggcagtgagggcgagaggaactattgagtgacaggatctgccgtcactgcctgccttggttttgctaaagtggttactggggaaggattttataggaaggggaactggtgcctatccctggcatttcccctttttacacctgcccaaggaggctctcctcctacataccttcctgtccttgcctaaggaagttccctaactccacccaagctgggaatgccttggttgcagatactgtgcagaaaagaagtaggaaataatgccttatgacggcccccaagttgagctctgtgtccactatgagttcggggtggggatcaggactctatagtttccctttgttcctctgggtaggaatatgagaggacaatattagtcctaagaagattctgatatgtggccctttcttcatccaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaaggtactggctctacccagagagaaggtagcttggaggagatccccgggctcaccaatatatacaagttacttacctctgtctgggggctccttaggctctgggtgtggggcccagctctggcatttactagctgtgtgacctcagagattgctatgaggcttctgtgagatcatgtacagtgcctagcacactgtaaaaagtgttcaatactaattattaatataatggaaagccaaggcatcaggtcaagcacagtatcaactaatgacatcccatacccatggggatgccacttccttctaggtcagcctcttgctacccccatccccattctaggaatgcaggatgaggaaagtgaggtcaggcctcaccctgctcattcccagttgtgttcccataggtaggcatgtgagaagcagcagctgtggcttgctatctttccacgagaggttggcagtgccaagattcagttttagctttgaaggcctggctcagtccattgagttgctgtagcttctgctgttgacagaggtgcatgttgcatttgaatgaagtccccagggctcctggacattgtttgacttgcatttctctttctgttgggcctgctggaaacctctgagagcctacttctgagtgtcccattctcaacggctcaggtgtccactaaatcaactctctgggaggtggtggtgagagtggcaaactgaaaaacgcattggattattttgcctcagaagtactatctatgaaaccggggtggctccagcgctgacttcttgctttctaaatcgcagatcctcccactgatcagggggacaaacctgctctcagtttaccacttgcatctttcgacgcatctgaccttgaatgcgctctatgtatgaggtacgtcctgtgtactatcatttacttcctgatgtttcttcatctctggtgtctggacctttctgctagtgacctactgctgggttggttagcatgtaaaaagcatagctctaacggaatggaaatcacaacgttgattgtcacatgggtcagcttgtgtccccttcccagagactgcattccctgcattcctggctcctgacttggaaaaacctggagagtgggaagggaacagtctattcacaggtcacaaactgatggcccactgggctgaatatgtctgaatatgtcttttttttttatgtcttttttttggagacagagtcttgctctgttgcccaggctggagtgcagtggtgcgatttcagctcactgcaacctctgtctccccagttcaagcgattcacgtgcctcagcctcttaagtagctgggattacaggcctgtgccaccacgcttggctaagttttgtatttttagtagagacagggtttcacaatgttacccaggctggtctcaaactcctgagctcaagtgatctgcctgcctgggcctcccaaagtcctgggattacaggccactgcacccagtctgaatatgtcttttgtttggccctcatggggtttgtttttcttaaacgtgaatgtcttgagacaggacatgtactctccatttgaccacgcccccgccacccacctgccttattccaacctgtgtgtcacaattgcattacattcttagcccctagagataatttaaattttggatcccagcactaatctcagttacatgggcaagagctcaaagttcaaggactactgtcaccaccacagactattcttgggaagccaagtggtgggcctgactagcttttgttttgtgttgtgccatgaatattagtggtgggcctgagatacttagccaagtatctccccaccaaacagtgccacatcatctctactttctcagatctctggagaggcaaattattcacatgctcccccaccccaaaagaaagaggctatgattatggtgtgtgtaaccatacacaattttttaaaattgcttacatgtctttgatttcacagctgtgacttactggcttagaggagaggctccctgctctgtcatttactggctgttgacctggatggagcaagtgacattctctgctactgttttcttgtcagtaaaatagagaacagtgtacctactccatagggttgtcatgattaattgagaaaaatctgtttaacacctggaatagtgcctggcatataatagatactcagtaaatgttaactatttttttttccttgtagaccagaggtccagaaggaaactttgggtctatggacctctgaggatgttctatatatggattctaatagatgtattaatgtctcgaagttgtatgttaaagtatgtgggttttccaggacaaggtccacatcctttagcagattcacaaatgtgtctgttttccaaaagagcattaaaaggaggctgagatatttgcacaaaaattaagacggttggcaggctgctgttcgttgtgctggcgggtcctgcggggagggctgtggagctccagatggactaaagaacaaaccagcaatcccgagagggcccacagtccctctgaaggaagcgggttgcttctgcaggacccaggagacaccccaaatactctgggaggcaaatagcctcggtcgagttctcaagtccctctcactctcctcctggaaacagacttggagctgttggggagggcacggtggaagtgagactggcccttcagtttgcatgggagctgggtgaggcctgtgactgctgtatttccccaacttccctggtaacctgcatgactcagcaaaggcagccataatcctcctaggtacacaactccagtgacctgggaatctcacccccatcccccacagcagctgcagcaagacctgcccaaggagagtctgagctcagacatacctagccctgcccccacccaatggtccttccctaccaaccctggtagtggaagacaaagggcatataatcttgggagttctaaggccctgcccaccgctggtccctctccacactaccacagctgttgttttctggaaagcaccacctcctggcaggagaccaaccagcacaaaaatagagcattaaaccaccaaagctaagaagcctcatggagtccattgcacccaccaccacctccaccagaacaggcactggtatctatctactgagagacccatagatggctcacatcacaggactctgcagacaacccccagtaccagcctggagccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacacccccccccaaaaaccacactagttcaccagcaatggatccaaaccaagaagaaatccttgatttacctgaataagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaagacaaagaaaaaaagaataagaaaatatgaacaaagcctccaagaagtctgggattatgttaaaccaccaaacctaataataatcggtgtacctgtggaagaagaaaattctaaaagtctggaaaatgtatttgggggaataatcgaggaaaacttccccggccttgtgagagacctagatagccaaacacaagaagcacaaagaacacctgggaaattcatcacaagcagatcctcacctaggcacattgtcatcagattatccaaagttaagatgaaggaaagagtcttaagaactgagacagagcaccagctaacctataaaggaaaacctatcagattaaaagcatatttctcagcagaaaccctaaaagctagaagggactggggacctatcttcagcctcctcaagcaaaacaattaccagccaagaattttgtatccagtgaaactaagcatcacttatgaaggaaagatagacattttcagacaaacaaatgctgagagaatttgccattagcaagctaccactacaaaaactgctaaaaggagctctaaatcttgaaacaaatcctggaaacacaacaaaacagaacctctttaaggcataaatcacataggacctataaaacaaaaatacaagttaaaaagcaaaaacaaaaaccaaagtacacacgcaacaaagagcacaatgaatgctacggtacggtacaccacatttcaatactaacaatgtaaatggcctaaatgccccacttaaaagatacagaaccgcagaatggataagaactcaccaaccatctgctgccttcaggacactcacctaacacataaagactcacataaacttgaagtaaaggggtgaaaaaaaggcgtttcatgcaaatggacacccaaaatgagcaggggtagctatttttatatcagacaaaacaaatttttttttttttgagacagagtctccctctgtcacccaggctggagcgcaatggtgtgatctcagctcactgcaacattcgccaccgggttcaagcgattctcctgcctcagcctcctgagtagctgagattacaggcacgtgccaccatgcccggctaatttttgtatttttagtagagactgggttt[132 bp omitted]aagagacaaagagggacagtatataatggtaaaaggccttgtccaacaggaaaatatcacaatcctaaacatatatgcacctaacactggaagtcccaaatttataaaacaattacgaatagacctaagaaatgagatagacagcaacacaataatagtgagggacttcagtactccactgacagcactagacaggtcatcaagacagaaagtcaacaaagaaacaatggatttaaattatgccttggaacaaatggacttaacagatacatacagaacattttatccaacaactgcagaatacacattctattcaacagtgcatgaaactttctccaagatagaccatatgatagaccataaaatgagcctcactaaatttaagagaactgaaattatatcaagtactctctgagaccacagtggaataaaactggaaatcaactgtaaaaggaaccttcaaaaccatgcaaataacatggaaattgaacaacctgctcctgaatgagcgttgtgtcaaaaacaagatcaagatggaaattaaaaaattcttcaaactgaatgacaataatgacacaacctatcaaaacctctgggatacagcaaaggcagtgctaagaggatagttcatatccctgagcacctacatcaaaaagtctgaaagagtacaaacagacaatctaaggtcacacctcaaggaactagagaaacaagaacaaaccaaactcaaacccagcagaataaaggaaataaccaagatcagagcagaactaaattaaattgaaacaacaacaacaatacaaaagataaatgaaacaaaaaatgttctttgaaaagataagtaaaattgatagaccattagcaagatttatcaagggaagaagagagaaaattcaaaaaacctcactaagaaataaaacaggagataccacaactgacaccactgaaatacaaaagattagtcaaggctactatgaacacctttatgcacttaaactagaaaacctagaagagatggatatattcctagaaaaatacaatcctcctagcttaaatcaggaaggatgagataccatgaacagaccaataacaagcagcaagattgaaatgataacttaaaaattgctaacaacaacaaaaagaagtccaggaccagacagattaacagcagaattctaccagacattcaaagaagaattggtgccaatcattttgacactattccacaagataaagagggaaccctccctaattcattctatgaagccagcatcaccctaataacaaaaccaggaaaggacaaccaaaaaaagaaaaccacattaaggtatgtcccttgtatgctgattttgctgagagtgttaatcataaagcgatgctggattttgtttaatgatttttctgcatctattgagatgatcatgtgatttttgttttgatttcttttcagtattatgttggttgtgggtttgtcataatactgaacggggaaaagttgaaagcattccctctgagaactggaacaagacaaggatgcccactcttaccactccttttcaacacagtactggatgtcctagccagaacaatcagacaagagaaagaaataaagggcatccaaatcagtaaagaggaactcagattgtcactgtttgctgatgatatgatcgtttaccttgaaaaccctaaggactcctctagaaagctcctagaactgacaaaagaattcagtaaggtttctggatacaagattaatgtacacaaatcaggagctcttctatacaccaacagtgaccaagcagagagtcaaatcaagatccccttttacaatagctgcaaaaaaataaaatatttaggaatatatctaaccaaggagtcaaaagacctctacaagaaaactacaaaacacaggccaggtgcggtggctcatgcctgtaatcccagcactttgggaggccaaggcaggcagatcacgaggtcaggagatccagaccatcctggctaccacaaagaaatcctgtctctactaaaaatacaaaaaattagccgggcgtggtggcatgcacctgtagtcccagctactcgggaggctgaggcaggagaatggtgtgaacccaggaggcggagcttgcagtgagcagagatcacaccactgcgctccagcctgggcgacagagctagactccatctcaaaaaaaaaaaaaaaaagcaaagaaaagaaaactacaaaacactgctgaaagaaattggagacaacacaaacaaatggaagcacatcccatgctcatggatgggtagaatcaatactgtgaaaacgaccatactgccaaaagcaatctacaaattcagtgcaatccccatcattcttcatagaattagaaaaaaaacaattctaaaattcatatggacccaaaaaagagcctgcatagccaaagcaagactaagcaaaaagaacaaatctggaggcatcaaactatctgatttcaaactatactataaggccatagtcaccaaaacagcatggtactcgtataaaaataggcacatagaccaatggaacaaaatagagaacccagaaataaacccaaatacttacagccaactgatcttcaacaaagcaaacaaaaacacaaagtggggaaaggacacccttttcaacaaatggtgctgggataattggctagccacatgtaggagaatgaaactgaatcctcatctctttgtacaaaaatcaactcaagatggattaaggacttaagcctaagacctgaaactataaaaactctagaagataacattggaaaaacccttctagacattggcttaggcaaggatttcatgaccgagaaccgaaaagcaaatgcaataaaaacaaagataaatagctgggacagctgggacctaactaaactaaagggcttttgcatggcaaaaggaacagtcagcagagtaaacagacagcccacagagtgggagaaaatcttcactatctgtacatctgacaaaggactaatatccagaatctacaacaaacttaaacaaatcagtaagaaaaaaacaatcccatcaaaatatgggctaaggacatgaatagataattctcaaaagaagatacacaaatggccaacaaacataaagaaatgctcagcatcactaatgatcaggaaaatgcaaatcaaaaccacattgagataccaccttactcctgtaagaatggccataataaaaaactcaaaaaacagtagatgctggcatggatgtggtgaacagggaacacttctacactgctggtgggaatgtaaactagtacaaccactgtggaaaactgtggagattgcttaaagaactaaaagtagaactgccatttgatccagcaatcccactgggtatctacccagaggaaaagaagccattattcaagaaagatacttgcacatgcatgtttatggcaacacattcacaattgcaaaatcgtggaaccaacccaaatgcccatcaacgagtggataaagaaactctggtatatatatacaattgaatactatgcagccataaaaaggaataagttaacagcatttgcagtgacctggatgagattggagactattttaagtgatgtaactcaggaatggaaaactaaacattgtatgttctcactgatatgtgggagctaagctataaggatgcaaaggcataagaatgatacaatggacttggggacttggggggaaaagtgggaagggggtgaagaataaaagactacaaatacggtgcagtgtataatgctcgggtgatggtgcaccaaaatctcagaaatcaccactaaagaacctactcatgtaaccaaatacctcctgtaccccaataacttacggaaaaataaaataaattaaaaacagaaattaagaagattgacccaagagaaaatataacaaaagtctttttatttatttcatttttaaaaataaagttaaattcattttgtttttgagacagagtctcactttgtcacccgggctggagtgcagtggtgtgatttcatctcactgcatcctctgcctcccagttcaggcaattcagcctcctgcctggcaaatttttgtatttttagtagagatgaggcttcaccatgttggtcaggctggtcttgaactcctaacctcaggtgatccacccgccttggccttccaaggtgctgggattacaggcgtgagccactatgcctggccctaaaaaagtattttcatacactacatggtgggatccagcgagcagaaactgctcagatatttcctcgccctttatgagcacatatgcttctcatatcgatcatgtgcatttgtattctgaatgatcgttgttggatgactgaaaacgagtaacacagccgttacctgaaatgtggaccttctttctcttaaaaaaaattttaggtgccagattttctcataagctttggcagacctgataacaaacagctcagcaggtggaatgttgaagcactcaaagcaagcctcccatgctgtcaggagttggtgtgggtggagtgggctagggtgggaggggctaaatgagcaggttcctttcactacttccctcaccccctcatgatagaatggcaggtgggttctggcaaagccaaggtagaagatagagaaatcctgcttccaggcagagcaatgggctcctgcaggtaacaccgttgtggctctaagcccatgatgtgcgctgtggagtagacttgacttagcctgctcagagaccaggtctttgttgtgcgtatccttcttaacactccctccaacatccaggggacaagaaatcaaacatacagactcatcctgtttgtgttttctctgaaaactaagaatcctgaggtgtaagttcttttgttcctctgctttctccctttcatcttgtttgtccttgaactcaacagggggctttggaggaggtctcaaaatttggtccaagaaataaacaccaagaggataagacccccttccagttggctcactcgaaatttaaaagccatcatttcccttatcctgcccctccgttctaagtgagacttcaaaacaaaacaaaacaaaaccctctgtgcctggagtagccattgcatacactgctaagttatagctggcctctcactgcttgatggtgataagaaacctactaaatctagaaagaactttggatcttgaggttctgaaaactgcagccattggtcagaagcatgtagttccctttccaacagggtttgtctataagttagacattggatgttgacagaggctatttcaaacacatgcttcagcttgaattatgatagccttgacaaagcttttgattccacctctccagtgtttttcttctctttcttgttgttaggaatatgattggttctcttattaccctcatgtgtccttgggggagagtgtctgagagtaaagaaagtgtctgaaacaatctgtggaggtcatgaaattagacatttgtactacttgtgcaagattttagtatgaaatccagtttcatggtgctgcattggtagaaaaacaagttagagtatgaatttgtatacacggattctagagagaaaattaggagaagcaggttgtaagttccacagggaaaagggtgaaaagagtgaatggaacaataatcggaggtgtgtaagtgaggaccattccaatctccaggtctcccttgctgaactgggggagctctgttgagagaagttaccccctaacttcaacccttaagaactctgctcctcaatccttagtggttgcaaattctcctttgatatttgcctcgtgtggttaccttagccattgggggccacctctggggctgctatggagcagaacttttggggtgacaaagacattttgagatatgcagtaagaatgtttgatatttgaaccagttatctaatggcccagtgacctctttgtcaattctaacaagaagcttcatatttaacctagttttagctactcaagtagcttggtgttaaggatcttgtcagttcactctcattctctctctctctctctctctctctctctctctctctctctctctctctctctctctctctctcactgtcactctctcttcctccctccctctctctccctatttctccctctccttctcccctccctcctctcctcctcctttcctctttgctctcatttgatagcaaaagaaaacaatacaaggatgtaactggtgggaaaagatagctatttccagacaagccaaacattttatctgggctgacatcaaactgaaagcatttattattgctattgtttactccatcactgtaacaatgtaaaatgttttttgtgtgaaaatctggccctgctctgatttataaatacctcttggatgtgttttctgaaatcgttacctaaagtggtaaaaaaattctagtcaagttctctctgtctctctctttttcagaaggagggagagaggagagagggagggaggaaaatgtgcatatgagtgtgtgcatctacatgtagatggatgatgtctatttggatgcagaaatacatgcacacatttgttgccgcatcatagagtgaagaagaaagatgggcttgagagtcagatctgacctgacatcccaaagccctgctacttaccagctagctgtgtgatcttaggcaagttattttaacctgtctgggtttaaattttctcaatagtataatgaagctaatcataattaccacctcttaatatacaaagttaagtattgacacaccaagaaatacagccagaaaaatatattccatctgttccagtcactttggctgtgcagagaagcagagtagccctaaatatagaaatgaattgagtattgaaaagtgtaatgtattctaagcatctgaaccctgaactatttcaaaggaataattatgcagcatctgtggccgcatttgtgtttgctaccactcagtcaggggcattttaatcacagcttttgctaagagattgctgtgtccttttgtgtgtgttttattcatctgctcactaaatgtcagtatttattgcaattaattagccagctatatctttgttattttagatagattacattaggttacattcttaaatgaacaataggcccaattgcaaaattctcaggaaaaatggttttgcatattagttgtagatacagattcatcaatcatcttcatcattagtaccatcaaataatataaggcattcagattcacaggactaagttaccaaggaaatgagatattttggtttggctgctctgataattagatcacagcagtggttccaaatcacacttttgaaaaacattttaaattgtgaaatacacacagtggaaaagtgcataaaatataaatatgttctcttaacaaaatattgtagagaagatacttatgtaacccctctcagttcaagaagtaaaatattgccaggacccaagaagctacccatatgcctcttcccaatcaggactatcctccctaccccaaccactatcttgacttttatcttgtttctctttttagctttactacccgaatatgtgtatctaggcgatgcaatctagttttgcctatgtaaaagctttatataaactgaattatccagaatttattatttcaatctggcttcttttactcagtattaggatttatccatgttattgcatataggtaaagtttgttcactttcattattgtataatatcccattatatgaatccaccacagtctgtttatcagttctcttatggatggatgtttggattgtatctagttaggggatatcatggacaacattgctataaacattgtttacatctgctggtgcttataagtgtttgttcattttctgttcgcttccttctctttttcttactgacttctagggtgtctatgtatgctctagatacaagttctttgctagtcgtatgtgttgcagataccttctcctactctggcttgcctttttgccctcttaatgacattttttgatgaacttaaaagcgcttcttcttgtttttttattttttttttattttgagatggagtctcactctgttgcccaggctggagtgcagtggtgcaatctcggctcactgcaacctccacctcctgggttcaagcgattctcctgtctcagcctccccagtagctgggattacaggcatgcaccaccacagtctgctaatttttatgggattttgccatgttggccaggctggtcttgagctcctcaccccagatgatccacccgcctcagcctcagagtgctggggttacaggtgtgagccactgcacccagccaaaagctcttcattttaatacagtcaaaattatcaatcttttcatttatagacagggtcagaattcattttttttaccttcaggtcataaagatattctcctattttatctttattttcttttatttgactaattaatttatttgagacatggggtgtcaaactcctggtctcaagcaatcctcttgcctcagcacccccgcctcaagtagctgggattagaggtgccagccactgtgcctggctatttcatcttatgaacgttttattgttctgcttttcacatttatttttacagcccacatggaattgatttttgcgaatgatatgagagatgatccaatttcatttccccctatagatagccaactctcctaataccatttattgagaatgctatttatgtattgaaaatctttcccccatctgctttgaagtggcacatttgtcataaatcaagaatccacgtctggatctgtttctgggctttctgttctgttccccgagtctatttgtccttgtgctagtcatatactgttttaatcactgcagctttatatgttctgtaatctggtagagtgagtcctcccacatcgttgctcttcagatgtatcttggctcttggccctttgcttttccttataaagtttagaaatcaacttgtcaagttctacaaaaataaacaaatgaaataacccattgaggttttttattgggacttagttgtttaatttctttcaatgaggtgtttgtagctttttccaatagaggtctcctacaactgttgttagatttcttcctggacacttgatttttaaaaggagttgcaaatgttatctttaagatgatgacatttctaatgtctattgctggtatatagaactataattgtgtgtgcacgtgtgtgtgtatttatctagtaactttgttaattccattcttattctaataatcatttgtagattcttttagatttttctaagttcaccatcatatcatttgtgaataatgacagatttgtttttttcctctccagttctcattttttttcttgccttagtgcactgagacctccatagtaaatagtttttcttttttaaataactttgctttttggccaatttgataactaaaatttattagttttaattaatttgttaaacaaattaactactttttaaacagaatcataaaattcaaaaagtaccaaaaagttgaatacatgaaaagtctctctcctcctccagacctccattggcttgttaaaaatatcccatttctgctggtctccttgacctgctgaatctggaactttagccagtggagcttcacaatgtatgggtttttttgctccacacgtaactgatatttgaagaccaatacagtaagtttgcctatgcagagattaatgggattgtgtaacacagtgatcctcaatcttggctgtacattaaaaccactgggaggcttaaaaaaaatttctgatgcctgtcctgtacactgggcctactgatctgaatctctgtaggtgctgtagtgggcatctagagttttcataggctccccaggtgactgggggaggcaggaaggagggcttacaaaggggcatgaggaaacatttgggagggatgggtatgtttcctatcttgattgtggcgatggtttcataagtgtgtacatatgtcagaacttatcaaattgtacactttacgtctgttccatttattttatgtcaattttgcatcagtaaagctgtttaaagataaagctgttcaggtgattctgatgcacagcaatggttgagaattattgttgtaatagaaaaggcacatgactgaagtggaagttggatagactttcatctgtcaacagttggctgtgcgcacttagacaagtaacttcaacccctgtggacctcaggttcattctagttagtgggttcagtttcttctcaagtacttttcagctggcatgttgcttcttctactcagtctggcagtgctggccaggctgctggtgcacctcctggccacacgagggagccgtgcagctggcagcctctgactctccactgaacactcttgtgaggtgaaaataggctggtcaggcaggggtctttcccttcttcctgtgctgctcctcttggtgagtgcaagccccactcctcaacggtcatcttcagctaccctcactcactgatctcgctgcaggtgagcctttttttaagcaaagcaaatccattaatttctgaaggtacagaacaaatttataaaaggattcccacattgctttgaaaatatcctgttctccccaagcaattaaaatagtaccaaattgaagtatatgtatgtatatatatgtatgtacacatgtaaatgtatgtatatatgtgtgtatatgcatcaatatagatccatatctagtctatatcagtaagcacactaacaatactattctcctgcccctatgaaaattatctatataaaaggcagttatgtttgttagaggtacaattttgatatccttcaggcattaacattgcttagacgaaaagaggaatcaaggttagcaaacggtttttttccatggtaatatgatgtaaagtgcttaaatgggtaaatgtgtaagagagagaatgtgtgtgcgtgtgtgtgtgtttgtgtgtgtgtgtttacatatactcaggtgaacaggttggctaaatattttcggaatggaatttatccagacactctgtgcattaatctctatttttcttggaccagacagggcaaaaaatctgaattccccagaagagatagactagaattgatgttacaaaatgatctagctatgccctaaactttaataaatgtattttaatccagctcaaaaatgaaaggcaaatgtttatctgaagtataacaatagcgactttttaaaaagaactcctcccccaccctaaaatattctaaataatgctttaaaaacttagctttgagtcactcttttatttttggtcttattgcagttttcttccattttgattcctaaatttcagattattctatgagccagtcacaacaccttgcgggcatactttttgcttaaaatgcctagaaagatgcctagatcacaacgcaaagtgtccattgtgcaaagacggtctttcacaggtaaatcaatatttctttcttgtttggtttaaatcagtatttctttcttgttttgtttagtttatttggaattgggcactaagacagtgttcaactggacccccagccacggcactgtggtagggcacattactccctcaaaccatctatttctcctgtcttctttttttttttttttttttttgactgagtctccactctcccacccaggctggagtgcagtggcgtgatcgcgggtcactgcaacctccgcctcctgggttccagcagttctcctgcctcagcctcccaagtagctgggattacaggcgcatgccaccacgctcggctaatttttgttttgttttgttttgttttgttttgttttgttgagacggagtctcgctctgtcgcccaggctggagggcagtgacgtgatctccactcactgcaagctccgcctcccgggttcatgccattctcctgcctca[222 bp omitted]tggtcaggctggtctcgaactcctgacctcaggtgatccacccacctcagcctcccaaagtgctgggattacaggcatgagccaccacgcccagcctatttctcctgtcttatagccactgtccccctctccataaagtccttcaggaaaatgaggcaacatgcagctttttatgcagtgtaagtagggaaattaatttgtgttggaaacgaaagtattaaatagatgataaacttggatcctggttctaatgtcatcgtggcacctgatacactgtaatcttgagtaaatcttttgtcccctctaggattggactaggtaagccctgatgttcccttatcatcagtgtttattctgtggcttgaagataacagctccaaaggccccagaagaacctcacagaacttcagtgtgatccttgtccaacccatcaggagccactgtacctggaagccctagagcttttgcagaccgcagccctctaggacttccaggttctctaaaactaatcacacaaactcccacctttgtttttcaagtgaacctgaaggaatttcctacagataaagaagacctgagaatctatcttgttttccctccctcagggacttatctgccacattttacaatcggtgttaatgttccttgacccctgtcattcctgaggagaggttggagatgcaaggctatctctaggtgactacaggtcaagagaagtcacatgttgagctttaccatcaccccagtatttaaattaagggaatggagtgaaatcatcatcactggtagccctgagggtatgcgttgggattgggaggagggtcaatgtcatacctttccctggataaagttgtaggatttgcaggcctgattgtaggtgagaagtccttgatccttatactgaaataatacatctgtgttgttgtagcactggaaaattcagattaagtggaaagaagaaaaatctacccatatgctcagtacctagagaaaaccactgttagttaacattttagtatgtgccttttctggctttttgttttagtatcagcagaggagtcacctactttttagactgactacctcctcagtcaatgcttatcccccacaactgggactgggaaatgcagttgattttcccatagccaggcaatggcagtgacagtggcagataaggcatcctggagacagatgctatagagttcaggacttggggtctagaagatattctcatctatctctgtttattcacatagggtcacacttgcaccattttacatagaattaaatattccaatcattttcactgcagaatagagacacagcccatactgagaaaggaacaaaattgtttgaagccaacagttttatactcaggcgctccccctgctgggactgtaggggtagtttccatagcaagcaattctctgcagatgttttaacatcagttgtttgattcacaccgttaaatacccactacctaaacatccctgggtatgcatcggacaggggtgtttgggaggagagtaacagtgacaattgagcctgagtccagttcttgaaatcatgacttttaatctcagtgatacctagatggtatattagaaaggcaaatagacaaatcaatatttagctgtttgtgtttttttaaactaaaattaaaagagaaaaaataggtatatttggcaatatccagaagccaagcattgggttaggctgggagtgggacagggcaggaaaggttcagtgattgaaaattgctttttagttccctgaaacttttggccactaactttgagcatatcccagatggagacaatttctgtgagcttgtaaatacaatcatcagaaaatggaaagggaagaattccccccaccctactttttggacaagaacatgatcttgatttcagtgtttcagaaaaactgtgagagttttaaaacttcaatgcaggttttacccccttgttaaaaatttttttctaattataaagataatcaattgcatgtgtgtttttttaaatgaaactaacatccagaaaatacatatattatgatggtaacagctgctaatttgtgggtccagattactccaatatgtgggtcatttgacttgttcactgattacatcagaagtgttttgctgattgctacgtattacctaattgcatattgtctaattgcctccccccatgtagtgcttggcatcaagaaaatacagcaaaaatgtaataatggaggagctcatagctaaattccttccagaagaactgaaggaacgaaggaagctttatgaagaggaaatggaagaactttctaagtatgtatatgcatatttctgttttgtttcactcataccagctcaatgagagctgaatgtgcacattacttcccagcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctgtcacccaagctggagtgcagtggtacgatcttggcttactgcaacctccgccttccgggttcaagcgattctcctgcctcagccacccgagtagctgagattacaggcatgcaccaccatgcccagcgaatttttgtattttttagtagagacagggcttcaccatgtttgccaggctggtcttgaactcctgaactcaagtgatcctcccacctgggcctcccaaggtgctgggattacaggcgtgagccaccatgcctggccacctcatggacttcttatgaaaatcaaatgagtttgtgcatagtaagcacttaattaatggtaataatactaatacttgtcaagcgctttctctgccgtgcacaggtaatgtgagaggtgaaggggaggggcagaggcgtcattgaggctctcagcactctgcctggctgtaagaacagctcccttagcagaaaaagcaggaggcaatcactaatttctgcctctcttgcttctgccctctcctccctccatccgcagtagaatcctaacagcattccagaggcaaggttcctgacagcaaaaatggttctggtttcatgcccactgtgtagagaacattcgtaaactctgccagtggcttgtttgaatgcactcctcacttagactaatgcttttctcagaaactagaaatcgttttttttttctcattaatttacattggaactactcgggggatctttatctttatttctgatctgtaaattagcattgagcctctctgagccctcatctcaaatctcatttaaggtcttattaacaaatactgagatgtattagggctttctatgtaaatgaatcctgaacttgatccttttgagatttgggcagttggtcttatatttcttgataggtttaggttcagatgttcctgtgttggatttactagacaaataagacaaggatcccagaagagctggctctgttttggttccccaacgggttgtgtgtgtgaatctctgggggtacttattgaaaggcagggccgggcatggtggctcatgcgtgtaatcctagtattttgggaggcagaggccggtggattgcttgaggtcaggagttcaagaccagcctgcccagcatggtgaaaccccatctctaataaaattacaaaaattagccaggcatggtggcatgcacctgtaatcccagctactcaggaggctgaggcaagagaattgcttgaacccgggaggcggaggttgcagtgagccaagattgcaccactgcactccagcctgggtgacagagtgagactccgcttaaaaaaaaaaaaaaaaagaaaaagaaagacccttgggtcccaattccagagctaatgcatcagtatctctggtaatgtggtgtccaagtcatcttgattgaagagcccctgttgattctgatgcaaagaagcatttgagcatcactgggctggattattcttgcctatctcttggtccttcctcctttcagctgtgcctcctttgcagactctttggggtccttgcaaatttgagatgccctagggaccttacagagaatttcccaccacccttctggagagctgagtccacttctatcatcagcaaccttccccatgcagcctgaaaaacacctgaaaagattgttttgagtggagagcatgaaagtaagaaaaaatatgaattatagctatcatccacaatattaagatactagagaacttcttcagccaaattaaaatgtgtagaatgccaattttaatttcttagaccttaggctaacctctgcatcagatcatgggactcagcccacactatcaattgcatttcaatatttttctattagccatcaaaacttgatgtatctttggcaagtgacactgtcaaaaaacaaacttggtgtctctgccttcccccaggggtatcacatgctaacatttgaccaatatttttgtgttctgtccgattgctttgagatccctgtcattttctctttctgacagccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtaagtgaggagccatgcgagcaaagggaggttgtgtaatgagggatttctgttttactttggggtactcccaggagacagggaggcctagctcatgaggtttagccaactgaagaatatgagcatttgtaaggatcattgtccctttggtggttagtttaccatgtgagaggctgtctatttaaagaaccctagaattaatatttggttaaacaggtggtatatgttataaaacttgtaagaatgtgggccttggagtcaaactgcctgctttcattatctagttgcagccttggagcaagtttgagtttgagcaagctatttaacctttctgtatcccagtttccttatttgtaaagtgggtacaataatagtacctacctcattgggtttgcttggaagattggtgagttaataatgtacataaaatgctgagcacagttcctggcttccttagtccattttgtgctactataacagaatgccacagactaataatttatgaacaatcaaaatttatttctcatggttctggaggctgggaagtcctaggtcaaggtgctggcatctggcaagggccttcttcctttatcataacatagtggaagggcatagcagaagggcaacagagagagagagaaagaagggggtcaaacttgcccttttatattaataacaaccctactctactttcaccatatcagcattaatgcattcatgagggtggaggcctaatcacctcttaaatgtcccacctcttaataatgttacaatagcaattaaatttcaaaatgggttgtagaggaggcaaacattcaaaccatagcactggcacagcacatagtatgtgctcaataaatggtagcagttacacgaatacattacgaattttttttcttcacacaggcactgcctgttgtgtaattgaagctgtaacccagggacaggaaaataggcagaagtcccttgagccacagcatggggctacagaaatggctgggtgccagcccagggaaacagaactcatcaaggatctagtctctcgactccattctcaataaacaggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggtaagggtggccagtgccaagaatcccaaagccaggctatccttgtaacttgatacacaaagatagttgtgaaaggatttctcagaacccttgagggccttgggatttcacaccaaattgctgcagcaacattgaatgctgctggattgctgtccagttgcactatggcagtgagggcgcctactgtcctggctctgcttagctgctgagttgcattcatgcataggaaatgttatcctagatcaaccctggggctcattcagcttgggagttaagtctctgccaaagattgcaaggaatggatctggggtgggtctatacatatatattttatctatcgatttatgtatattttaaacttttttcttttgagacaattatagatccacacatgcatttgtattttaaagtacgtaacctggctaagagcccttcccaataatccatcatcccctaaggcagaaagatgacacatctagttaatccttggttttctgaggtaatgggtggaagaagaggtaaataatcctatattcatttatatttacatttgttacatagtagattaataaatatctgatgactgagtaaatgtgtttgaccaagatagttacatgctgagactgacatactcctgtgtcttttccagcaagtaatgagaaaacagatgtaaaaatgaaaagggcaaaggcatggaccagcataacctggtttaaccacatgcctccactcaggccggtttgaatctctggttttctgcatgttttgctgtttcagctaatctacccagctgaacctttctccttcctccatggtcagcagtatctacacactgtccagcacttgactaaggggcatttcacatcaagcaaaggagaaagctgaatgggtgagccttcccataggaaggcaggatggatgctcaaagcgaatcaggtgtcaaaagtgactctgggaatgatggagagggtacagaatgtttcacttccactttgatactttcaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaatttggagccaaataatttcaggtgtaggcactttgaccagaatggttctctatagtcctaaaaccaaacttgtgaaagttgtgggcagaaagctcgttttaggcttagaaggaaataagtacccaatgtctaaaatatgtgccagggaagctgctttggggaaggatttatgtggaatgggaaagctctttattaaaaggaaatctaggggcagaatatatttctttctttctttctttcttttttttttttttttgagacggagtcttgctctgtcgcccaggctggagtgcagtggcatatctcagctcactgcaagctccgcctcccaggttcacgccactctcctgcctcagcctccggagtagctgggactacagaagcccgccac[182 bp omitted]tggaatttttgcaaagtgagattgtgattctttgggactgtaaatcatagcctttggtttcaggggagaagagagctatggccctgtatagtgacatggtatacatggactattgccttcagccacatcaaggaaatgaggggacttaaaagacatgcaaaggtcaaggggtcatgggaatcgaaggcctgaatgttaaatgcatcagtccaaaggacctcaacagaatattagaagtggaagagactacatagtagataccagcttgtaaaatcacattggctaggaggcatggtgtatctgttaggatactggttggtttgctttaacaagaaacaaaaatgactggagcttaaacaagatggaggggctaagtcttggacagttagggcagctctattccacaagagcattcaggcacccaggctccttcatcacaaaactctaccatccttaaaatgtctccctcatcctcttgattgagaaaggctgatcctcaccacgtccatgttctagctaggggaaagggagagaaagaggaaggcagagggcatatgcttctttcccagagcatgaccaagaggttacacatatcacttccctttacatctcattagccagaactttgtctcatggcctcacctagctgcaagggaagctgagaaatgcagtcttttttctgggtggctatatgccctgctaaaataagggggaaaatagatatagggtcaattagcaatctgccacatggagttgttctacctggggtctttaccttgagcatttggaactctgcagactgatgttcttggatgggaataggatgactccattgtgtttctctgttgcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcatagatcaatgactgtgtggttgaaatgtgaaaacaaagatactaataatgttgctgtataatttcactgacttgaggtctcattccaaatggttcaggttttatagagcattgtgtaaaataatgttcatacttctttctgttttaataatttattttttgcactactgtatccttttttctacatgtatgtttgtaactatttaagcgtacattgctgaaaagtccattgctttatttattgatgtggtttaccatgtacctagggggaaataacaatactagaagtgtgcagtttttgcttttatcttttttttactacaatgacactagttcttagaccatttccgtatctatccaaatggatgcttaaaagaagttcagaatgatgctaagatcatctgtcttcagagtccacttttttttttcagtttgaactaaacaatataaaatacttaagggatttggcctagattatggtatatgccaaggtaaagtaaaataattcattttctgtgtgtaatacagaacaaagctgaaagaattatttttattataggcatttacttcagcaatctaattgtacgtgtatctaatttttccccagtgcagttaggaatcggattttgggcaggatcataattaactcttcagaggaaatggtgttcagtttagcacatcacagtcatgcccaactagcctccataacccacctctccccggggttctgaggatcaagacctggacagaaacacttgataaggactttttattattaaaatgtaaataagacaaa[144 bp omitted]gaaaccctgtctctactaaaaatggatacaaaattagccaggcttggtggtgtatgcctgtaatcccagctacttgggaggctgaggcaggagaatcacatgaacctgggagatggaggttgcagtgagccgagattgcaccactgcactccagcctgggcaacgagcaaacctgcgtctcaaaaaaaaaaaaaaaaaaaaaaaaagggaaccagataatctattattttacctaagtactgcctttgcttctagttgcatgggtgaaatatttcaatgtatggggagaatatagggtgaggagtaagagtaagccctgatttagcttgcttagtgctagtttgagtccttcagtggcaggacagcctgtaaagtaccacaagtatgggagtgttataatggcagagtgaaacgattagagcagggaggaagtgaattgtgccattagtaccttcatgcaaattataccatgtgattttggacagtgaatgatttttgcatcattcattcacagcccatcactctgttaaggtgagagtgtaattcttacttctcccatcaccacctgtagctagaaacaggaaagggagaatgagatgatccagacaacataaaaaagatgcatgtaagcagaaaccagatggtcttttctgcactcacttaatggacattatgttgccagagtgttgtgtttatcagatttgatgtttggagctagtctgggcaggtgaagaacagaaataggcggaagtataggcattatttctgcgcaagcaaactccacaaagctcagggagcagaaaagactccccctcccacctggttcccagaccatgtggtcataacacaatcctaatagtttctggttatctagtgtaaatgcaacaaagaaaaaggccctaagcttctctacttattagatatattatttttggcaattgatttaacttttgccaaccctcagttttctaatctatgaaatgatagtgataagttctgcatatagggttgttacgaaaattaaatgagataatgtgtaaatcaattagcacagtgtctcacacctagaatgcactcaagaaataatagctactattagattagtcatagttatagaatatcatcaagggcctacatttgtataaaacactgcctttacacacaatatccacttgaaacccctttaaacttagttgggggaatacataccactgatttttggacccataatttgatgatttacagataattcttttgggaattaaatgtgtgtgaaagtgaaataactggagaacaaatgagggtcagagatagggatcaatcctataccagaaatttttttcctgcttcaataagggctagaaggtagtgccctatgtaggtctaggatttctttcttccttccttccttcctttctttttcttttgttccctccctccctccctctctctctctttccctcccttccttccttcctttctttttcctttcctttcctttcctttctttcttttgtgtgtgtgtgtgtgtgtgcgagtctgagtctcactctgtcacccaggctggagtgcagtggctcgatctcagttcactgcaacctccgcctcccaggttcaagtgattcccttgtctcagccccccaagtagctgggattacaggcacgcaccaccacgcctggctaatttttgtagttttagtagagatggggtttcaccatgttggtcaagctagtctcgaactcctgacctcaggtgatccatctgcctgggcctcccaaagtgctgggattacgggcgtgggtgtgagccaccgcacccagcctaggatttctgatagaatggaagccttaagttctagctccattagaataaccaacttttcactccctgttctccaaaatgtattgagaaccttacccatcccagatgatgagagtttacaatctgtgacttctgttcttagttgatagtatttctttatgttgcccaaagtaacagattcaacaaaaaatgtactgagatccccatgtaccaggtactgagccaagtgatctcacatacctgagctcattacatcatttatttctcataccaaccctgcgagagcagttattatccccatattatgaatgagaaaactgagcctccactatgttaaatattttgtctagttgcaaggcaggatgcaaggctaagctttggctttctttgggatgtaccttaacgaggtaatcaattggtcttgaacatttttacactgggaaattggttttgctgcacagcttgggaatgaagggtatacagaagaaagacataaggctaaatctaggccagaaaaataagacttcccccacagtagatagtgccacttatttagttagtttttctgtctatcatgactgacccagtctttgcctagtaggttatattttgtatgtatgtatgtatgtatgtatgtctttgtgtgtgtatgtgtgtgtgtgtatgtgtgtgtgtatatatatatatatatatatatatatatatatatatatatacactaggtagcaagcagacatcatatctttctgctttgtactgtactactgctgctagcaaataaccagcaaaatgtagaaaatgaaaaaccaattttctgtagacaacctggagaaaagagtgcctgcccctgacttagcggggcagagaatgacaatttttaaagtttgccttttctgaaggttgcttttagcccagtgctgcctcagcagcaaggggcaagcagagtcattgcgcatgtggcgcttccagctctacctgtggagctggcctgggctcagataatcccctgtgactggccattggagcggcggagctcctgaggctagttcacagcacccagaggtctcttacagtcaacagattgcatactgttgacagactgcaatccgtctgtgttccccacaccaactccatttccaagatgggaattttattcaggaactcatttttgagttcccaacatgttgacttcgcatccatttctgctcaccaaggcagaaccatagcagtggtgtgtgacaaagatgcaaatggagggcagcccaaacaatggaaaagagaagattttcagcccattcttggggctaagtgaggttttgatttatggtagaagacagttctaaaaagcagctggcagcatgggcttcaatttgtggcccttctgagttcaaacagaaggaaggaaaaggagccacataaagtgtacacattcaattcatcttagaatgatagctcccaccttattacactgtacaactatttaataatctgggttacacacatccagaggtgaaataaagaaattttcacttacaaatgtgtatttccaaacatgctaagttaacctccagagagaagtgcctgtaatctctgttcctggtgtcactttaaagcttttgcttcatgactgtagctgttgtttaaaatgtttttgcagcaaacgcgatttaacagaagtttacaaagcaacactgtagctaatgcataattttaaaagttgactaacatttatctattgttaaagcaacactaataatggaataaaaggaaagcaaataggccaatgtggcaccataggcttattttaggtaaattagttccatcatcttatgcagttgtaagtaatgccaggattaaaatatcaagcaagccacgtaaacagtggcaaatgtgtgtgtgttttccatttgtttggtaagcagccattttactcttgcactgtaatgaactgaagggaaatataagataatgcttttttccccccatattgctattcaactacctctatatgcttgatttctttttaggattcccatcctccaaatctgtacaaaaacgtttcagctcatctgtgttgtaataacaatgtgatacagacagtttgtgtgaaagttgtttgttcattaaaaaatgtttcctattgcctcactttgtgtccaacaaaactgtattcctaccttaggaaaagaattatccaactagcttcagtatcacttcggtggaagctgaatagaaaggaatgcttcaggaacatctatttgttcttgttcctattggttgtaataccagaagatcctttaaagaaatatacttgcattcagacagcaaactcccatgtatgtgacagcgaggcaggtgtgaactgattaatgtgactgatgtgttctgaaaaactggccataaagtgtttcaaaatgcaccagaaaagcttgttacataaagaattatgttgaagcattttgtcaatatctgcccctactttatatgtaaatccaagcattcacatattgggtttgcttaaagcacaacacactgcctactattttctttggcatcataaaatgttcaagaaaacaaataacacgtttttattttaaacaagcagtttattaacaataggctaaaagctaaggccccaaacatgaaccttttaacaggaaaattggtaacatttgtgacaataagtgatactgaccaagctgatcccagcagaagagcttcagcaacatcccatcttctctacagtactgattttagtcttatgctattgataacttttaaatgagttcttaccgttgagggaagaaggacacaagaatgggacaattaaaaatgaaatgatagaaaattccacttgagcttgatcttattctgtgtaacaggaccttgggggatatagaaaaaaatcagaactcctgtccatctaggccccagaggaaagacttggctctgttagacttcatccttctgtgcccagtctgccactcgctggttcttaagagatagagtacacttaaaggcacaagccagtccttccaagacagtcctgcccagaatccctgcataatttttctctggagaaccgaattgagccatcttaaaagaagcttctgtttgcagttgtaccccaggcctttgttagaaccaaagccaacacttactgcatcctctcttctgggatccactctggctttttttttttttttttttttttttgagacggagtcttgctctgccgcccaggctggagtacagtggcgcaatcggctcactgcaagctccgcctcccaggttcacaccattcttctgcctcggcctcccgagtagctggggctacaggcacccgccaccatgccctgctaatttttttgtatttttagtagagacgggttttcaccatgttagccaggatggtctcgatctccttacctcatgatccacccacctcggcctcccaaagtgctgggatcacaggtgtgagccaccacgcctggcccactctggctcttttgagttctccagggccaaagatgcctccctagaagataacaccagttgaaaaacgagatatgaacaagagaaaggaaggaaaaatgccctagactcccagaagcctaaacttttccgtgttctcttatgttttatgatttcttcattcccaggagggcctgaggtgggatgggaaggggctggtgtcagtactccccatattgacttcttcaggtaatgtagatttcctagccagacttgtctgtggtcagctcaatgcagaggtatgttctggtcaaggtagagaagtgtaagttctgaggagccctgcctctgtatctctgaggccccttctcccaccctttacagtttttggttactgattttcccatttcaacctatactcacattgactggtcatacacgtttcctgtccacttacacacatatattatcaaatgtcatcgttgcattacaaagacctgaaaaaattctactccatttattgaagtacggcctcccaaattgcacccctttgcagaatacttcctaccttctagtaagtcaatatcaacaatttctggacactacaaatgctgcaaagggccgaaatagcccacttgccctaaatccagttttgctacagaaatcttgcttctcttggattttagaagggcattatggtgatattcgatacagtcatgggaacaggggagatcattgcacctttggcctatcaggatgtctgttgccactggtagaaggcaactctacagtctcaggactgtgtgtttcttctgcgagctgaaatgaacactctcataagaagatagttgttattagggaagggggagcagtatgtccacaaatggagttaagcccttctgcttaagcagtctacagtgatgagctcccattggacagagaaaaggatggggagaggaaaagaaggaaaagagaggaatgaaggcagagaagggttaaatggctaattatgagagtcgaagtggttaccttttcatctcctggccggaacatcatgtatcctcttcccatattaactgtggacttgatcttccatcctgatttgggaagtcacttatgcccaaactaagactgcagtcatgtcttcagaaaatatgagccatgttcttgcaccttgtaggctgatcccagaaaggacagacagtgtatcagcagctcctcattgagctggtcactgatccaaaggccaagccagtgtccattgagtgttcattacgtgccatgtttgtttctagaatttttaacattcttcttagaaataataatctgtggccaggcgcggtgactcacgcctataatcccagcactttgggaggctgaggcgggtggatcacctgaggtcaggagtttgagaccagcttggtcaacgcggtgaaaccccttctctactaaaaaaaataaaaataaaaaaataaaaattgccgggcgtagtagcccgcacctgtaatcccagctactcaggaggctgagccaggagaatcgctggaacccaggaggcagaggttgcagtgagctgagattgtgccactgcactccagcctgggtgacagagcgagactatgtctcaaaaagaaaaagaaataataatctgtgaagtagagctcttcacaataatctgaagtagagctcactataatatgtgaagtagacatcttgttatatacttgttataggcaagtaaactatggcacagggtggttttgttacttaccaatggtcatgctgattaagatctgggccagagcccgcatggattccaaagcccacaatcttacccactgttacgggccgcccattgtgtagtgccacagacccaagagaacaactcagttcataaatgcaaatcgaaactacgatgagataccatctcacaccagtcagaatggtaattattaaaaagtcaagaaacaacagatgctggtgaggctgtggagaaataggaatacttatacactgttggtgagaatgtaagttagttcaactattgcagaaaacagtgtggtgatatctcaaagatctagaaccagaaataccatttggcccagcaatcccattactgggtatatacccaaagcaatataaatcattttattacaaagatacatgcacacatatgttcactgcagcactattcacagtagcaaagacacggaatcaacccaaatggacatcaatgatagactggataaacaaaatgtggtacatacacatcatggaatactatacagccataaaaaggaacaagatcatgtcctttgcagggacatgcatggagctggaagccattatccttggcaaactaacacaggaacattgcgtcttctcactcttaagtgggagctgaacaatgagaacaatgagacacagggtggggaacaccacacactggggcctgtcagaggggtggtgggagggagagcatcaggataaatagctaatgcatgtggggcttaatacctaggtgtcaggataaatagctaatgcatatggggcttaattcctaggtgatggtttgacaggtgcagcaaaccaccacagcacgtttacctatgtaacaaacctgcacatcctgcacatgtatcccagaacttaaaattaaattttaaaaaaatgtctggtggagaacgtccagtaatgttgacagcaaaacaacagcaaccatttattgaatgtgaactaatgtgctgtgcactgtgctaagcattaccttatttagttctgaagtcggtgctattattacccagcttttacacggcagctcagaaaaataaagtgacttgttcaaggtcatgtggttaggaagcagggaggctgggcttgggatccaggctgtctgccccacagctgttgttcttactcactctgtgagttagggtgcctctcataaagcccaccattctcctcacttctcgggccttgattcctgtgccttatcatattctaactctagtccctccaaacctgcctcctcttctgtctttggggtcctcctccatgaaggcctctctccctaatgactacaagctctggggccccttgattatcaacacagcttgcccaacttgttcttctccctactcacctctgtggccgatttgatttatttttgcattaaagaaaaaataggagtatagatttggagattcaaaaggcaaaataaaagataaacgttgaaagctacatacatacagatgtatgttctagagtcatacatcccagtgtgtccggaattggtgggtttggtctcactgacttcaagaatgaagccatggatcctcgcagtgagtattacagttcttaaagatggtgtgtccggagtttgttccttcagatgttcagatgtgtccggagtttcttccttctggtgggttcgtggtctcgctgacttcaggggtgaagctgcagaccttcgtggtgagtgttacagctcataaacgtggcagggacccaaagagtgagcagcagcaagatttattgccaggtgcaaaagaacaaagcttccacatcctggaaagggaccccagcaggttgtccctgctggctagggcagcctgcttttattcccttatctgacccccacccacatcctggtccattttacagagagctgattggtccgttttgacagggtgctaactggtgtgtttacaaaccttgaggtagacacagagtgctgattggtggatttacaatcctttagctagacacaaaagttcaccaagtccccactagattagctagacacagagcactgattggtgcatttacaaaccttgagctagacacagagtgctgactggtgcatttacaaaccttgagctagacacaaagtgctgattggtgcatttatgaacctttagcgagacagagagttccgattggtgcgtttacaatcctttagctagacacaaaagttctccaagtccccaccagattagctagacacagagtgctgactggtgcgtttataaacctttagctagacacagagtgctgattggtgcgtttacaaacctctagctagacacagagtgctgattggtgtatttacaatcctttagctagacagaaaagttctccaagtccccaccagaggcagaagcccagccagcttcacctttcagtggccctcgccgccgcgggactttgcagcacctagccctggcactccggcagcccagagggagctcgtccccgatcaagcccaacaggtgccggcgcccacctggaacccacgctggcccgtgagcgtgagcgctgcgtgtagcctgctcccctctacgcctctccctccacacctccccgcaagcagagggagccagctccggcatcggccagccccagagaggggcccccacagcgcagtggagggctgaagggctcctcaaacgccgctgaggccgaggaggtgcccgagagtgagtgagggctgctagcactttgtcacctctcaccagtgctgagggaggccttaagaaatcattcagcccagctaaatctcctgctttcagccactattatttttcccattttgcagataagagaactatggttgcacaacagtgttcaagatcactccatgagttagtggccaaatgagacaagagcctaaaatgtaatgcacactcaacacactagaagaagctcacagctggccctccccaccccgagtgttctgatgtgtggcttcttggacatggaactttcattgggaagaacaaagaattttttaaagagctacagcctatttggaaagtcccctttagggactgttctctctctgaccctccctgacccaaacttctctttagattgcttccctgttctaggaacctttctctcacacaatctgttacttaggagaaatcttccactccattcacagaagtttgggtttcatgaaagtgaggcagactgcttttggctgaaaaagaggaacctcatgcctgccaactcacacaccctgtgcccccagtcattcaggtgatcatggaaggagttggaatggctatcacagttatgagaggtgacagcgtgctggcagtcctcagagccctcgcttgctcttggcacctcctctgcctgggctcccactttggcggcatttgaggagctcttcagcccaccactgcactgtgggagcccctttctgggctggccaaggctggaggccactccctcagcttgcagggaggtgtggagggagaggcaccagcgggaaccggggctgcgtgcggagcttgcacgccagctggagttcccggtgggcgtgggcttggggggccccgcactcagagcagctggccagccctgctggccccaggcaatgagggacttagcacctgggccagtggctgcggagggtgtactaggtcccccagcagtgccagcccaccggtgctgtgcttgatttctcaccaagccttagctgctttcccgcagggcagggctcaggaactgcagcccaccatgcctgagccttccacccactccatgggctcatgtgcggcctgagcctccccgatgagcaccaccccctgctccactggcgcccagtcccatcgaccacccaagggctgaggagtgcaagtgcatggcgcgggactggcaggcagctccacctgcagccccggtgtaggatccactaggtgaagccagctgggctcctgagtctggtggggatatggagagtctttatgtctagctcagggattgtaaacacaccaatcagcaccctgtgtttagctcaaggtttgtgagtgcaccaatcgacactctgtatctagctgcactggtgaggccttgcagaacctttgtgtctagctcagggattgtaaatacaccaatcggcactctgtatctagctcaaggtttgtggatacaccaatcagcaccctgtgtttagctcaaagtttgtgagtgcaccaatcgacactctgtatctagctgctctggtggggccttggagaacctgtgtgtcgaacctctgtatctaactaatctgatggggacctggagaacctttgtatctagctcagggattgtaaatgcaccaatcagcgccctgtcaaaacaggccactgggctctaccaatcagcaggatgtgggtggggccagataagagaataaaagcaggctgcggagccaacagtggcaacgtgctagggtcttcttccacgctgtggaagctttgttctttcactctttgcaataaatcttgctactgctcactctttgggtccacactgtttttatgagctgtaacactcaccacgaagatctgcagcttcactcctgagcccagcgagaccatgagcccaccgggaggaacgaacaactccagacgctctgccttaagagctgtaacactcactgcgaaggtctgcagcttcactcctgagccagtgagaccatggacccaccagaaagaagaaactccgaacacatctgaacatcagaaggaacaaactccagatgtgccaccttaagagctgtaacactcaccgtgagggtccgcagcttcattcttgaagtcagtgagaccaagaacccaccaattccggacacagttacgactaaaatcagactttgggatcctgatccagcatagacagcccttcagcctgcagtgctttccactgcatttattaattcattaatccatccatcaaatattactacagtgcagtggttgagatcacagaccctagagttagactgtttaccttagaatcttgcccccaccacttactatctatgtgataaagaaactgttcctgtttccacatctgcaaaacaattgtgtctacttcatagttcaggtcatcaaaatatttcctgtaattttcccacccaaaatagacatacattatctttttaaacaggaagacaagaagcaagagatttcaggactggggtcacaggttcaacaatcccatccaagtgcctggtctatctttcctgaatgtttttaaagccccatggtgaagtagattcacaaaagcagcaagtcaatccagtcctttctgctggggaccagatgccttaaagggagggttttttgttggctaacaggtctaaacccacagatgaaggaatttttaaagggagaaagggggaattctagtgctcacgcctacctcaaggttcaaatgtgaggatgttcacttacagaaactgccaggaaaatagaggctcagctatcatggtaattcttagtccaggccctaaaagggcattaacatctctaatttattcatttattaatggaacaaacatttgcaggacacatatcatatgctaggcattgggctatagagaggaatacaacactatccctgcccttgagaagtttgcagccaaaggaagaaaacacggacttattcattacacagggcatggtggtggtacctcacaggaaaggcacctaatgttgcctggggaggtgttcagggagggctttgggaggaggtgatgcaggagctgaactcagaagaatgagatgctttccacgtaagagagtagagaagggtcgaagcagatgagagagtagagaagggctgaagagcactccaggcagacgcaacaactcatgaaaaacatctgatgatccatagagagagaattgaccagtcgtgtggaatgttatgagcagttcagcctggtaacgaacagggcttaaggtatgcaagttcctgacaggggagcagggcctggtttctcacggttttgtttcattccaattaaaatctggtctccaagggggtctccaaggaggtctgtgcagcaggcttttgagtgagggggagagggttggcctatgagagcccagcttcctggccaagtcggtttaatgggtagccaccaagggagtccccttggcacagcctgatgctgggtgctgggctcaggaagccccttagggtttgcacaagaggaagagaagtggtagttggtgatacagacaatttttgaggagtgattggagtgttcagaagtgggggccaggcacagtggctcacacctgcaatcccagcactttgggaggctgaggcaggcagatcacttgaggtcaggagttcgaaaccagcctggccaacatggcgaaaccccgtctctactaaaaatacaaaaattagctgggcatggtggcatgcgcctgtgatcccaactacttgggaggcagaggcaggagaattgcttgaacctgggaggcagaggttgcagtgagctgagattgtgccattgcactctagcctgggaaacaagagcaaaactccgtgtcaaaaaaaaaaaaaaaccatagaagtggggagactggctgggaagggaggaggaaagcaagcagttggcatgactagaatcgaggattatgatttatatgacctggaggctttgggataacggacccagatgaatctcttcaccttgatcaaccaaagacaaaccagggctctggcatactagaactggctcatactagctcatgagagctgatcattaagacttcaaaaattttgaaagccagctgttaaacacagccattatttaaaaaaaaattatctaaacttacaattaagtaacattaaaaacaaagtaataaatactcaaaacctattgcttcctaattattttactacttttaatgttatctgtgctcttgaaggtatttaggtctactgcatctgtgtggtggcaatgctactatagaatggtgtgccgctaagcagctcttcccaactccacgttcagtgatgtcagggtggtagctgaaatcggcaaggtgggagtatttacatcacactagaaatgaaggcacgcctcacagagaactggttgttacatttttccagcacaccactgcctctgggcatgcttcctttctctgtctttatgcttacttccaatgccaatagggctgttttcaggaaaaaggaacccccgcaactaattcacatggatatgtaaattgctaagagtccagatttctggtcttggtttttaggtaatttatttgcactttaacagagatctgccagagacaccatccataatggtgtggttgagagatatgttattgaaatgtgcgtaataaacaacactctcctacatttttgcttacggccatccctccagctcacccccttcaaaccacaagatagaaattatttcccctgcctaggatttcagtggaataaagcagttgaatccctcatcattcatcccactaaggccatgacaagatggactgagaggtccccagcccaggaactcccagctagagaagtttctgtgcaccaccacgacacaggggtaaataacaacaacaacaacagcagcagcagcagcagcagcagcagcagcagcagcaaatatgtatttacagcttcctatataacaggcaaagtactttttaacacaacagtccaataggtcaagtactactatcatccccattttatagaagaggaaaccaaggctcagagaggttaaggaacttgtttgaagacacacagcaatggagcagtggagggggatctgaatgtgggcaggctgcttccagagcactccttcttcgtgttagagaactttctcccattaaagttgtcctcgtggctcttcccatgttgggagaaaagctgagtgttgggagagaagctgaggcagggcttgcatgtctggtagacttgctggccccttgcttctagcactcccattatctcaagtagccatatatttctcattcacttgatacactgtttcctttcaacccccacatcctcaccaactgtttctttgatcaccaataaatagggtgagctcccagagctcggggcctttgcagcctccatactcacgatggccccctggtcccactttcaatctcaaactttttctcattcctttgactccaccagactttgttgcccccatgacctggtgttgggtctgatcaccccaacattcccatagctcagcccagactcattgctgctctctctgaccagcccatttcctctccctgtccattgtgggccagcacacctggaaactttgattggttgctgaacttgactgttataaatgagaaaattacagaagctgagaaagtcccaggccattttcattttacgatctttctaatgtattaaagcagacaaatgaacaaacaaaaaatgaggaaatgtcaaagaaaaagttagaaaatatgtggaaatatcatgcctgtaatcccagcactttgagaggctgaggtgggtggaccacttgagctcaggagttcgagaccagcctgggcaacatggtgaaaccctgtctctgtaaaaaatacagcaacaaaaaaaaattggccaggcattgtggcacgtgcctgtggtcccagctactcgggaggctgaggtgggaggatagcttgagcccaggaagtggaggttgctatgagctgagattgcaccactgcactacagtctgcatgagagagtgagatcttgcctcaaaaacaaataataataaagataacaaaagagaatttgtgaaaatacattcacacatttaatacacagcaacttaatgcaatataaatttgctatttataagataaacggagagttgttcaatagggatatttttggttttgcaagataaaaaagttctagagatctgttgcacaacaatgtgaatatagttaatgcaactgaactgtatatttaaagatggctaagatggcaagtttaatgttacatggtttttaccataattaaaaaaaatctttttgtgagtattaaaaaaaatgaggaaatgccaaagataaggctgcaaatattgtggtaacacatttgcgcatttaatcacagagcagtttaatacagtataactttgctctttgcaagataaatctaggatttatataaaaattaatttgtcctgcattatatgcagtgtggtctggaaaggaaacacaagcttaaatgtgtttgttttgttttttttagacaggatctcactctgtcacctgggctggggtgcagtggtgtcatctcggctcactgcaacctcctctgtgcgggctcaagcaatcctccagcttcagcctcccaagtagctgagactacaggcgtgtgccaccacacccagctaatttctgtatttttcatagagatagggtcttgccatgttgcctagcctggtctcaaactcctgaactcaagcgatccacccacctcagcctcccaaagtgctggaattatgggcgtgagccaccacgcctggccacaaggttaaatttgtatgatgaatgttgtctctgttcagtcctgtccataaatctctgaatgtatgaaagatagccttttttttgtgagataacctcatagaggcccttcaagaatgtaaggccggcttggtgtggtggttcacacctgtaatcccagaactttgggaggctgagtagggcagatcatgaggtaaggagttcaagaccagcctgaccaatatggtgaaaccttgtctctactaaaaataccaaaattagccaggcatggtggcgcatgcctgtagtcccagctactcgggaggctgaagtaggagaatggcttgaacccgggaggtggaggttgcagtgggccaagattgcaccactgcactccagcctgggcgacagagggagactccgtctcaaaaaacaaacaaaaaaaaaagaatgtaaggccttgatcaaatggcttttccagctgccctctacacatttcacccaacacagggcttgttgcagcaaaaggcctgccacgagtactgtctgctgcacttggcatcacagcgccagctctcactgtagctcatagaggggcagcacaagcatgaaagtattgctgtatctcagtgattaccaccacacacagatagtggaacactatctgctctccagaaaaaggcacgcacacacacacacacacaatttttgcatgcactttgcatacagtctacagacctcccctgaatcaatgtgtactctggtataaggctttctacacactaaagtccacagtccttaataggaagttctaagccataactgtttgagactatcaaggttgcattaacatgagagccccataatatttcaatatttgttggtggctaagtatattaggacaacacgctaaatttggacttatcccaaactcccactttcccagtctgacaagtttggggactgccctctccaccccttctgacttagtctcccaggcatgctggctatctagctatagcctagaattgactcagcaaataagcaaatgtaaatactcactgaatctttctggggccattctgtggaaacagaaatatatttaagtttttctgcctttgagaaaacactgtagggcatatccctgggcagatatatttggtggctcttagaccccctgacatacacccccaggccatcctcatctatttgctttctggcttctgatctgggcccttcctgggaatagtttttctctgaccctagagtctagaccaaagccaattggacattcacttcctggtgttttttttttcttttttttttcacatttgtctggtagtttctgtcctggcttccccatacttgggctctcctatcttggattcataattatatttctagccactttttctttctgactcctttagctcttcttttctttctttttttttacaattatattcgtataaatttaaggaggacaaatgcagtttcattatgtggctacattgcatagtgttgatgtttaggcttttagtgtatccattacacatatagtgtacattctacccattaagtaattttttttttttttgagatggcgtcttgctctgtcgcccagactggagtgcagtgacactatctgcgctcactggcaagctccacctcccaggttcacggcattctcctgcctcagcctcccgagtagctgggactacaggcacccaccaccacacccggctaattttttgtatttttagtagagacgggggtttcaccatgttagccaggatggtctcaatctcctgacctcgtgatccgcccacctcaccctcccaaagtactgggattacaggcgtgagccactgcgcccagcccccattaagtaatttcttatccctcacccctcttccaccctcccacccttctgcctctccagtgattattacacattctatgtccatgtgaatgcattatttagctcccacttgtaagtgagaacatgcagtatttgactttttgtttctgagttgtttcacttaatggcttccaggtccattcattttgctgcaaaattcataattccattctttttatggctgaataatattccattgtgtatatatatcacatttcctttatccaatcatccattgatggacacttagtttgattccgtaactttactattatgaatagtgctgtgataaacgtgagtataggtgtcttttggctataattatttcttttcctttgggtagtttcccagtgggattgctggatcaaatatagttttattgttaattctttgaggcctttcattacggtggggtttttttgttctccctttcccctcaagtagcctctgaacattacatgcctaatcatcctctccctggctcagctgatggtcctagcatctcccactgatgggctttttcttattctcctgaagagtttcatatggcttcacaagatacaactgcattttgatcatgattctcattgatttctgctttgcagaaaacaaacagacaaaaacctcacaactcaggaagccacgttgatatattttttaaaagtctagttctgactatttttctattctccattggcttttactattcaaaacccctcgcttgccagcagtagcattacacctatccccacctctcttagctgtggggctaaaggatagaacattctatttggctaaagagaaaaggtaatcagactgagcccagagatgtacacataggggctcataaacaaaacaacctcgtttcactcttttacagcagaattttagctaggtcacttctactaacagccatctattgggggaaaattaatgactatcaatttacaaaacaggattatggaaaacttttaaatgagagctagatagagaaactcttgggttaacgctcctcagtgacctagaagtatatcgaaaaaacaaaatagtgcatttctgataatgaaacatgacaaccgtacctaacctttttaaattaacagtggtgcatatatactgtgatcttttcaagggcagcaggaccacatttgaatcattttctccataggttatcttgaggaacatgatagtcaaatgtccctaggcatctccacccatctgggctttgggtcatgaattgatacttatacaggaactagctgccattaggtggagcaatttgaagtctaataggccatctagaaggatatcagatcaggaggtttaagaactccagatgttttaatttaggtgagtgcagccacaaggctgctaggacattaacaaagaactgattgatagagaagaaaaagtagctggtattagataatggtattagataaaagtagctggtattagatgatgggaggggcctgacgtctggttgccaaggcacctaactcttcactcgatagtcccccaagcacaggattcatggcttttgtggccccatcccttgggcgtagagcataatccttagctgacctttgaaaaatgcaacctcaggcttgcccggcttctggtacttccaactcttctttgccattattataaacacaattatcagtctttgaggggaggctgatcttttagttcagatttccagagttcagattggcaggtgtcctttgtcatctcataaaggaattaaagtgacctgagaaaatgtcctctgggtaagatcaatgccacctgtactctgtccttgcccaaactctttcatcagagctctcatgtgcatcagcccttccccactcccttcaagcctgtacagcctgggcatgacaataaatttggtcctttagcaatagcatgtacaactcccaggttattgtctatcctttttgagaactcaataggattattattatttgagacagagtgttacccttgttgtccagtgggagtgcaatggtgcgatctcggctcactgcaacctctgcctccggggttcaagcgattctcctgcctcctgagtagctgggattacaggtgaccatcgccacgcccagctaatttttgtatttttagtagagatggggtttcagcatgttggccaggcttgtctcgaactcctgacctcaggtgatcgacctgctttggcctcccaaagtgctgggattacaggtgtgagccaccatgcctggccaggattatttgattggaaatgtgaaaataagaaacaaaacaaaaataccccaggagacaaattatatttgtctaaggtagaaggcttcgaagtattccccactgtgaaagaaaacattatacttaaaatatacccaattcttcattgaatagttgatttaacttttttttaatttaactttttattgggggaaaaaaggtcagtagagcaaaggtttctatagcaacctggcagccgcacctctggtaacctatgaaataattaagttgagaggtgcaactaggtcagagaagagctttatgggaatcggctgaccaatgagtatataattggaataagtgaagatcacagcccactcacccaggaggaagcaagtaggtctttataaaggcccgaggctgcatcactcttccctattatcaggagggccttcacctggggtgagagacaaggcgtgtgcatgttgtgcctatgttttcaggatgggaagtggtggggaagtgcattaaagaatgaaaaaaacaaaacctaagaaaacagaaagcttaacagaaacatgttgttcctatgttttcaggatgggaagcggtgggggaatgcattaaagaaggaaaaaaaacccacaaaacctgagaaaacagaaagcttaaggtttgagttagaagtctggcactacccagactagacgatccctgctgctcctgctaatctggtaagagtgggcaggcctctttttgatgggggagaagggtcggcggggaggcctattgttattcccctataaccggctggacttgggagtaaagcgatatgtggacaagaaaacaggaagaccaggatgggcatgctggcagttacaaaaaacctaggcttgggaacctgaaggtttgccaacattaggaaggctgagctatccgagagacacattcctttcagtcctcattcttccctatcctgcaacctattccaaccactgtaagttcccattatgcctacaagtggcagataaaaaactggtacttaatacagagactgctggaaatgaatacccaccattaggctcttttatctcagcaacacctctgcaaaccggatgcaaatagattaatcaacccagtttcatttaatgtgggaattgcagagcatcatacaaggcaactgttttcttttgcatctgctgaagagcacgagggttgatttagaaaaaaattgtttccagcctgggtcacacattgaaggagagagagatggattctcttttctcagcatcctgtgggaggaaagcctgtcgcctgatccacatcagtcctatcataggggtcagggtccccattctcaccaatcatgcaaatgccaaaagaccagtctgggatgctgcccaacttcttgaccctgaaaattgctttcttgtcaacatcattgctgtctcagaacgcacctctgacctccccaatccccaaacagcacacccaggtggcttattcgttacctttgatcacatttgtctgagagaaggtaggagtgcaggactgaagaatgtgtaactctgggggagtagtggtgagagaggtcagttggggataacaaccagagctacagcactcatgcgttggctctaatactgaagtccagggtcatttccagcttgctgagtgaccttcagtcctctatgagtcacagctgcagctgagtcataggcagtgggagacaagctatgttttccgcttctaggccttcttcctcatcccctcccatactcttcccagctgattgaggaaggagctgtgtcttctattattattatgacatttgatggcttcggagtcatacagatttgtcatttaccacctgtagattacatcctctgtctgaggtttaatttcctcatctacaatgaggagataaaatggtgctttataatatgtcacaggattatcgtgaagtttaaagaagataaatcatgtaaaaaatgtctcaaagtccctgtcacacagtaagtgctcgaagagtgtgaatcattattaaattactcccccaaatcattttggaagttaaattagttgatgaaatctaatcttggagtcactgctatatagaggtaaatagaaggttatctccactgtaaatcactaaattggccatgtgtgtttaaaatccatttattatgagtttgattagtgataattatctccccagaacctcatcaccctggaagaggaggcagtgatctaatctaatttctgcatcctaaaagctgaggatcaaccctcagcacatgttgacccaatcgaaggccacatatcccaaaaagctaggcatgaaacaacacatgggcttctctctgagcttccctaatgcttggtaaggagtgtataaatgcattaactaccttctaccatgaatgtagtgactatcttctattaactaccttgttagacttctgttagggtctatcccagggttctctgtgttcatactaacggaatgatttgtgcagcccatatagaagatgatgtcattgttcatcactgtcagtataacttgacctttgaccacttgggtgctccctgggttcttctgcacacttgaccttttaggcatcccttggatgccctaacatcatactcagctctcaatggaactgaccagctctcaaattgaaggctattttgcgaggttcgttctctggaaacagcacattaatcaatatattctttttttagacagagtctcgctctatcgccaagggtggagtgcagtggcacaatcttggctcactccaacctctgcctcccaggttgaagcgattctcctgcctcagtctctggagtagctgggactaccagcgcataccaccatgcctggctaatttttgtatttttagtag[152 bp omitted]ttgttttttttgtttttccctcaaaagaaaggaaactctggaagtgagcttctatgaaatgttactaagtctttccatgacagatacagagatctaatttcagggcagtgagtgcttttaatatcccccccaaatcagtgaagaccaattcaccacataacttttcaatctcagattgtagtcataggaaatagaaaggcttccagcctccagaggaaacttttttcccccagaaacaaagcttcagtaatggcacacacacacaaaaccaaaggcaagatctgtgcggatattttaattgttctagacacagtcatcaaagaactatcatgtgggcacccctgaagcacccccatgtgttccaaatgcaaagagtagagtcacttaaatgttgacaataaggtgtggccttgacagcctcattgggcatactaatgacatacagcctgtgccaaccttctccaacaggttattccagggttcctgttgtactttacccctcacaacagactactgctatggggagaaatgtgctgcagtgctggtgaggagcctgtattttcctctgataacctcatggacatttaatccaataatttatgggaaaacatttctgtttcctgaagtttggagtagtagaagtcagatagagtggacttttcagcaataagggggttatggaattgtcgtggaatgatatttaactttggaagggctcgtatgtccacatttttaacaagtgaataaactaagttctagagaggttttgtcatttacccaaggccattatgtttatttagtggcagaatcaggactagaatccaggacccctgatacccaattcagtgccctttccaggacagcatgcaactttccactgtaatatcatttgttttaccttaaataataacagctaatacttattgattactccctatttgccagaattgcactaagcacaaaacaaatgctaggaggtaggaacttttattttctccactttatagatgaagagatggaggtttagagaggccaagtaactggaccaaaattacacatcacactgcacaactcttttaatgtttaacttactaagctaaccaatccaatccaagaagaccactcagactagagaagatacttacattgaccagaatctataaggcagaatgtcagaaatctgcgtacatttttaaaaatttttatcctgaaaagataacttcctgtgttaacacaagtctatttctgggagattcttcccccttctgaatgctctcattgacattcaccactatgtttaggattgggaacaggatgagcctttacaaatgtgcacaagttggaattaagagtgggcaggtagagatttgagaattgaaatatacatatttttttagacagtcttactctgtcgcccaggccggagtgcagtggcatgatcttgactcactgcaacctccacttcccaggttcaagtgactctcatgcctcagcatcctgagtaactgggattacagaagcgtgccaccacgtctgaataattcttttttgtatttttcgtagagatggggtttcaccatgttggccaggctggtctcaaactcctggcctcaagcaatcctcccaccttggcctcccagagtactaggattacaggtgtaagccaccaaacctggctgagaattaaaatattgatcaaacagattgagtattctgagctgctcagaaaagatacatttatttattccatttgtcatttccaactcttcatgaatcttcttctgtcgatttttggtagaataaagccacttaaataaaagctacttgaggtaataaagatatcttctgttttattctcttttttcccccacaagatttcttcatatgcatttcccactctgctcctctgcaactgagcaccaggtgtcctttatatcactcaggtaaccataaaacaacactttgaagccactcatttattcccacaaatggacagaaaaacacaagagaaactatgctagaatgtacaggttatgagaacctgtgtggttatttagcaaatgtcttcttcagtttccattcaaatcacttgggtctctatgatttccacaagactatgtcttggtctgttttctgttgctgtaacagaatgccatagactgggtaatttataaagaaatttatttagctcacagttctgaaggctgggaaatctaagatgccaaagccttactggcatctggtgagagccttcttgctgcattgtaacatggtggagggtatcacatggagagaggtcaaaagagtcagagagactttgcttttataacaaagccactcctgagataatgaacccacttccatgataacaacattaattcattcatgaggccagagctgacattaatccattcatgaaggtagagaaattaagtttccaacacacgaactttagggggtacattcaaacaatagcactgtccaaacattccactcttcattggaagtagagtttgaactaatagagttagtaatttggagagttggattatagtgtcagccatccgctcagaaactcagtttccccaaggtttaatacccactttttcaacatacacagtgattataaagacatcataagaaaatatgtgaatgttctttgaaaagttacaagttatacaaatgcaaattatcatttgtgatggctaattttgtgtgtcaaccagactaggcctagatatttggtcaaacattattctgggtgtgtctatgagggtatttctggatgagattaacatttgaggagctgcgtggcggctcacacctgtaatcccagtactttgggaggctgaggtgggaggattgcttgagctcaagagttgaagcccagcctgggcaaaatagtgagacccccatctctacaaataataataataataaaatagccaggcatggtggtgcgttcctgtaatctgaaatgagaggatcacttgagcccaggaagcagaggcttcagtgagccatgattgtgccacttcactccagcctgggcgacagagtgagaacctgtctcaaaaaagaaagcaacacaaaaaaaaccaaaactccattataatcaatatactgagtaaagcagattgtcctctctaatgtgggtggggatgggcctcatgaattagttgaaggcctgaatagaacaaaaaaggctgaccctccttctagtaactgggaactcctcctgcctgacattcttcaaactggctcttctttgagtcacgagcctgccagcctttggactggaactacactgttggttcttctgggtttcagtcattctgactcagactggaactacattatcatcttctctgggccttcaccttgccaactcatcctgcagatcttgggatgtgtctgtctccataatcatgtgggccgatttctaataatttctctctctctctctctctctcctctctctctcttcttttttttttttttttttttttttgagacggagtcttgctctgtcgcccaggctggagtgcagtggcaccatctctgctcactgcaagctccgtctcacgggttcaagcgattctcctgcctcagcctcccgagtagctgggactacaggcgcccaccaccacacccggctaattttttgtatttttagtagagacagggt[143 bp omitted]tgctccaaacttagagttcatttatgcaataaatatttattgaatgtttgttttaggtgctgtagatgaggtgctaaataagataaacaaggtctctgttctcatagagcttacattctaatggagaagaaagagaaaataaacaaaacagtaaatacagaagaaaatatccagcaatgatgaattatttgatgaaaatcaagcagagatatgtgatagtgattgaattgagtaaataggctaatttagattaagtgatcaggccttcctgaggtgatgacttttaaaggaagaactgaatggcagaaaagagccaaccatgggaagatatggggggaaagagaaaagagctgcagcaagactctatggttgtgttgaacttggtgtgttcaagaaatagaaacagagataggctagagcatagtgaataagaaattagtacaacatgatgtcacagacataggcagaaaccatatcatataaagcatgtagggcatgatagatttatgtgccagaagaagccattgataaattttaggtaaaagagtaccatgatctgatttatgtctttaaaacatcacttgagctgggcgtggtggtgctcacctgtagtcccagctactcagcagctgaggtgggaggatcacttgagtttaagactggcctggacagcacagcaagaccttttctgaaggaaggaaggaaggaaagaaagaaagagagagagaaagaaagaaagaaagaaagaaagaaagaaagaaagaaagaaagaaagaaagaaagaaagaaaagagagagagagagagagagagagggagggagggagggagggagggagggagggaggcaagcaggcaggccgggcgtggtggctcatgcctgtaatgccggcactttgggaggccaaaatgggcaggtcacctgaagtcagtagtttgagaccagcctgaccaatatggtgaaaccccgtctctactaaaaatagaaaaattagctgggcatggtggtgcacacctataattccagctatttgggaggctgaggcagtagaatcaattgaacccaggaagtgaaggttgcagtgagcagcgatcacaccactgtgctccagcctgggcaacaaagtgagactttgtcccaaaagaaaggaagaaagagagaaagagagaaagagaaagaaagaaaggaaggaaggaaggaagaaaggaaggaaggaaggaaggaaggaagaaagaaagaaagaaagaaagaaagagaaagaaagaaagaaagaaagaaagaaagatcactctggtcactgtatagagaataaggtgtgtgtgtgtgtatgtgtttgtattcatctggcaaagaaataatagaatacattttaataatagaataaccttaggcttggcctaaggtggtggtgattgagatggatggatttgggatatgttttggagctacagcaaatactacgtcttaagatattgcaggtgagtggtaaaagaataaaaacaattaaacatgaactttaggtttttgacttgagcaactaagaactgaagtgggaaacactgtcactggaggtgggaaagaatcaagagtaccgtttgggatatgttaaatttaagatgccatagaagtggagagctggatatacgtctggagttcttggaaaaagtcaggcctggagatgaaaataaaggcgtcaacatcattgacaatatttaaagccatgggactggataggattgctagagagagaggggatgaagagcaagagtccccgggcagagccttggtcattctaagacttaaagattaagcagaggggtaggatgcagcaaaggaaacttagaagagattggtgaaataggaagaaaaatccatcgagtggttccccagaagtctagagaggaaagtgtttcatgaaggggagtgtggtaaagcatcttgaatgttgctaaaaagcaaaggaaacacatagagaaatggacactagattttgcaacatatcagatctatgttcaaaagatcactctaataacagcatggagaaagggtttgggtgggcaggaggtggtggcaagaatggtaacaaggtgataacagttaaatgatcattgttaatgcaactacaagagaaagatcacaaggaccttgactgaggcagtgatagtgatggtggagaggaggagatacacacagaaaatcagtcaactaaattcaacttatatcacagtcaaaccttagaagacatcaaataatataaaagcaaaaagcctcatccaaaggacagcaacttcaaaaattaaaggaacattatcccacacagataagaaagaaccagtgcaagaaatctggcaactcaaaaagccagagtgtcttcttaactccaaacaatgcaacagctttccagcaatggttgttaaccagattgaaatggctggaatgacagaaataaaattcagaatgtgtatggcgttaaagatcattgagattcaggagaaagttgaaacccagtccaaggaaactaaggaattcagtaaaatgatacaagagctgaaaggtgaaatcacctctttaagaaagaactaaaccaatctgatagagttgaaaaactcactataagaatctcgtaatacaatcagaaatattagcagcagaatagactaagctgaagaaagaatctcagagcttgaatacaggttcttcaaatcaactagtcagacaaaaacaaaaagaatgaaaaagaatgaataaaacttttgagaaatgtgggattacgtacagaccaaacctatggctcattggcatccctgaaagagagggagagagagtaagcaacttgggaaacatatttgaggatattgtccaagaaaaatttcccaacctccctagagaggatttttgcctgaacaaaactgataccaaaacctggcagagacataatgaaaaaagaaaacttcaggacatttgctcatgtaacaaacctgcacatgtaacccctgaacctaaaataaaagctgaaaaaaaaaaacaatgtggtaacagagcaaagatagacaaatagtccaatgaaacaatagagaatccaagaaataaccacacgtatatgaaacttgataaatgaaataaaaggaatggcaaatgttaaaaaagaaagaaagtagattcgtagtttcctagggctgggggtagggggagatggtggtagggcaggtaaaggataatgggtattgatggctaatgcctgtaat[132 bp omitted]tgaaaccctgtctctactaaaatacaaaaattagctggatatggtggtgtgcacctctaatcccagctactcaggaggctgaggcaggaaaatcacttgaacctgaaaggcagaggttgtagtgagctgagatcacgccactacactccagcctgggtgacagagcgagactccctctcaaaaaaaagaaaaagaaaaattagattttgcacttttttttttttttgagatggagtcttgctctgtcacccaggatggagtgcagtggcgcgatctcggctcactgcaaactccgcctcccaggttcacgccattctcctgcctcagcctcccgagtagttgggactacaggcgcccgccacc[182 bp omitted]atttctctcaacaatgttttgtagttttcagtataaaattagattgtggtgaagaatgtacaactctgtgactatactataaaacattgacttgtccacttacaataggtgacttgtatgatatgtgaattatatgtcaataaagatgtcaaaaaataaaaaaggccttcatacctcctcctgcttgccttgtctctcacctctgttctacctatattgtggccttcagccatatctcagtaaattccattccccaattagcatccatacttttctgcctctgtgcatttgtttgacctcaactaattccctcttatttcttcctgtggaaatctcatccatcctccaagactcatttccattcctttgtcactgaccagatattctaacttgtattgtagttattggttgttgtcttatgcccataattaagctggaatcccttgaggtcacagttcatgtctgttttgctacattcctgcagaacctagttcagcaataattaggaactgaaatgaattcaccttgaactaagagtgctccacaataagattttcctttagctcttttaaaactttgaaatactatgatttttagttatttagcctcaacagtttttatagccatctctgaattcctgctgagtttttagccctttgttagccatatggtcatggaatgctgagagttcttatccttcactactctttaattcgatatatgtatgacatgaaatatatgtatacatgcacatatggtacatatatacataaatatataaagataaatataaacacatacatattgagagagagagaatatattatatgccagatactgggaagatatcaagacataaaagtcataaagagttaagagttcatagtctttgcaggtggaaatgaaggtgggcatatacagacataataaaacttctagatttagaagtgcacagaggaaatagcactatcttgcagtgagggactactgagtgccagtgctgttctcctcaacctacctcaactctgcaaagtatctaagtctttttaactgcccgagtgtcatttgaggccatgtctaatttacagattggcttgcttaattttcaaccatattgcttttcaagtgtcttatttttttttcttattatgtattaacttgtccttaaacagattttgtttattgacctattttagaatttttgttgtcccttttctaaaatttgaaaactaatatgttgaagcctgtaatttctcaatgtaaaagatatctagccatttaatcaagttttaccacatttcatcaataactcaaagaaatagacaatatccattttattatcactggcttcatctaatcaggcttaagaatgctttcaccaatgggtgaatatgggccacagatgctcttaggagtaaagtgaaccaaaacactgatttcctaattcaagagttatccaacacttttaatagtcacatttaattactttcttaaagctacaataaataaaaattttaaaaaataataaaatagtttgaagtaaccacagctttccttatattcctgcaattcttcttcttcttcttttttttttttttttttttttttggtttacttggtgtcaacataagtgtctgggaaaagaactcaagtgaagaacctcagtcaaaagacatacatcccatccttgtgccaggtggaaagccaacctctgaaatgccaaagggatcggtcttctgattaatggagggtttgatagaatgtatagtttattacatttttggcccttaaaatttttacccaaaatgggtgaatccactttcatgcctgagtcctaacactaatgctcttagaagaggaggtcctcagggtcatcattctgggccgtcttcatccggaaccaaaaatggctcctgagattggatttactgtctcctgagtccaaatagtcctagatttgatttcaaaacatcccatcagcctcttcatattctcccagcctgtggcttgccttttcattcacttaatagaatcttttgaagagcagtttttaatagtaatgaagtcaaacatatcaattttttctttcacggattagccttttggtgttatatctaaaaatacattgccaaactccaaatcataaagttttctcctacgttttcttctggaccttttgtagttttgcattttccatttagctctatgattcattttgggttaattttgtgtaaggtgcaaagcgtgtgttgagattctctttttgtatatggatgcccaattgtttcagcaccatttattaaaacacccaattaatttttgtagagtgactggattaattttgaaattgctggtcttggttatacattgtgctcctgttttctttacatgaatggtaaaaattttgaagttcttaatcattgcaagatggcctcagcgggtttcttgggtgacgagccagtacattgtgatccataaaatctttttggaatataaatactgatatttatatactatattattttatatttatatttgttggatattcagcttgttgaagtaacaagagaaaattatttatatttgttaacaagagaaaattatttatatttgttggatattcagcttgctgaaataacaagagaaaattaggtgacattttaagaagaatttaagacctagtgattggaagacttggaagcttgtgtcaatccaggaaatatcacttattttaagaaacctgagtgtccctcacacctaaatgaattccaaatgggtcaaggattttacaacaaaatcatgaagaaatagaagaaaacacaggataatttttatatttaattttgcagttgagaaggcctttttaagtatgacagaaatccagaagccataaaaggaaacattgataaatttgaactcatataagtaaaacaacttctgcatttcgaaatacactataaacaaagaacaatgtaaaaaataaaaatgacagactgggaataatacttgttacatgtatcacagacaaaaggataattttcttattatacataaagaactcctacaaattgacacaacaacaacaacaaaagccatcaattcaattcaagtttgcaaaggaataaataaaaagttcataggaaatataagagctgcatcagctcatgaaaagatgcccatcaatagtagtaacaaaagaaatgcaaaataaaaccacacccagataccatttttacctgttatgttggcaaagacacaaagtttaattacaccttgtgtgatccaaggtgtgggaaaataagtaccctcatgcattgctggcaagagtgtaaactgacaatactatcaagctggagagtgatttggcaatgtctattaaaatcaaaaatgcacttacccttctcacacacacacatacatcaatattcactcattgcatcattattcataatagcaaaaaattgaaaactatgtccttcaattaagactgattctacaaaatacgatacatacatacaatagaatactatgcagcctttaaaaaatgagacagctctctgtagtttgatactgaaggatctccaagatgtagtgttaagggaaaaacaaagcacacaacagtgtctagtatgcaacatttctaagaaaaacatgttatagactgtgtaagtgtggaacgtctcttaatgcacacaaggaaatcagtaaccttgtttgtctcaggaggatggtttaagggagaagcaggaggaagtcttgcttttcactgattgtctttctgtgcatgtattaatattttaaaaataagataatttttaaaactgaagtgatagttttcaatgtcgttttagaagccccttaggttcttaccctcaggatgccaacgccaaagatctggctcctcaagtagtgccccacaggctggttaatagctccacagagggagattttagaacttggtgctcttttctatatatatatccagcctgtgatggactcttaaataagaaaggtccaacagtgcacattgttgtttctgtggttagctcatacttagcatgacactggaaaaacatccatgggaatgggagtggaagcttcaaatgcacttttcagatctatgtgagaaatttctgagtgtgaatacctttctcaaattaataggttaagtgtttcatgtgttcatatgtttatatacatataaaaataaacctacaaaaaacacacaaaagggttaacaacaacaacttctggatgatgggatcataagctgtttttcttttttttttttaatttttgtaattttttttgttttttgtttttttgtttttttgagacagggtcttactctgtcacccaggttggagtgcagtggcatgatctcggctcactgcaatctcaacctcccaggcacaagtgttcctcccatctcagcctcccaagtagctggggttacaggcacgtgccaccacatctggctaatttttgtattttttttagagatacggtctccccatgttgtccaggctggtctcaaactcctgggctgaagcgatctgcccacctcggcctctcaaaatgctgggattacagacatgagccacagtggccggccatacactaattttctttgtattatttaatcatgtgcagttttaaattttctacattgaacatggattgattgtgtaattaaagaaaatctctcttcctttgagcattattgtccataaaatattaccttgtctaatttatgctctacgtcattaaaaatgagcaatcaagaaatccctattgtgttaacgtactaagaaaaagatgagtgtgacagaagaatggtacaagacccctctgttcaggcataaatcttattctaaggtcatctactttctgttcatggaagaaggagcatggcctgctcactggttaaaggtgaccctggtatattaagatgagaaaaactggtgagcaagccaggaaaagcaagtgcacatctcagaagagtcagggccaggcctgagaaaactatgaagtaggcccacaagtgaccccagctctgtatgattccattttgctcttctatagcatccccatttctggcccctttcaagagggtggaagtgagaagatggaaaaagtgaaggtgttactgggaagtgcaggaatccttggttcttgtctaatttgggagaaagaatttgtccaagggacaattagtaatgcaagccaaaggtttattaaagagataagagtacaacccaagagaggagccagttaacttggctgcaaaacagctctgggctggtctggctggaaagcagcagcagcagcaaggtttatttaaacagacagtacactctgaagcacgagtcagagcaggctgctcaaaagaatgggctagcagcagctggtgctgggggactctaagagaatcttacttgattattcatgaaggggcataacggggtgtcacttgcaatcatgttttaggtggtacccttgggtacacatgctggatgatggtacatgttagcatgcatgacacatgtatcattagtatttaaaatccccactcaagggtctgttttttactattataatgagcaaaagggtactctagggcaagctattggaggagtgtgcatgcacatctgcctgggaagtccctatcatggttatctccaactagggcctgataagtctccttcagggctggaggagcccaaccacaaggccagaagtagccagtgtagcccatcttttttgctgtcagtgggcagcgtctctgcgacttcttttcccaggggctcctttgcctgttcgttcctggttatctgcctactctaacaaagggactttgtggagggttaggaatggaggtaaagtgacagaagactctcttgcctggcatgaataaggggtttgccgcagctttatctctcacatgtagaagtggcttctaagggtaagcatgagacacaggagccaaacagggaggacaatggagagaaattccaaatccattgctcaaataagctttgttagaggcaggcagatggaaatcctgcagctctgtattccatgacatgaatagtttattgtaaagattaaaatattcctaatgactgaggcaaaatgccggttggatttgtcaagttgtatgacaagcttgcttctgtttctggaaaaaaaaaattgtcacagaagctgactgagctgtggccaaaaagagataaagtgtaataatttacccctcagccattacttcttgttttaaatttcttggtgggaaaaaattcattatgtccgctatgaagaagagaacaatcctggagggcttctatttttcaaaaggcttgagaattcttcaaatgaaactgcagcacctatacgttcataaacttcaagtagttttaacataacattgtctttgttatcatgtcaatcttagctcaccaaatctagaagcacttgctgtgtaactttcccgtgttaatgatcctaacaggtttttcagtacttctaaggctattaggtctctactgctcagcgcttcacttggaaagaaagtatggatttgatggagtaggaaagatacacgttgccaagttacagtttcccatctagattgtgtcacccagagcaactcatcaagggacaagattatgggagaaaaagaaaacatgggaaacaatgttaagtaattgaaaaagttccatagccagagactggagtccttcagtactggtttccattattaactcgttcgacgagatgaagataatgggactgaacattttactaagaacactgtaagtatttcaaaagcgtctaaaatcatggcacacagacagtctccatattgttattctctatgttagtgagtgggttgctcctgagcaagtagaaatttaaatttaaagtttctgagataattggcacaggagtatgaatttgagtttgttattgtgggtctgtgattcattcataattaaagaaatatgatcatctgtaaaatgtggctaaaaaaagaaaaaagaaatattttattaaattttagaaaaaatgttgccagcatgtttttcattgaaaagataatgtatcaaaaagctaaaaacattttctaaaagaaaatatggccgggtggcgtggctcaagcctgtaatcccaacactttgggaggtcgaggtgggtggatcacctgaggtcaggagtttgagaccagcctggccagcatgatgaaaccccatctctactaaaaatacaaaaattagctgggtgtggtggcagtagcctgtaatcccagctactcgggagacttaggcaagagaattgcttgaaaccaggaggcagaagttgcagtgagttgagatcatgccactgcactccagcctgggtgacagagcaagactccgtctcaaaaaaaaaaaaaaaaaaaaagaaacaaaatatgtttaatagttgtaatcagagtcaacttgctttaaaattttaaaatctaatacagttcaaattgagtatttttgcttattaaacacagaaatgccaattcatatacagaattattcttttagttttactgtttgtttatttacttatttatttcatttgaatcagggtttcactctgttgcccaggctggagtgcagtggcccgatcgtagctcactgcaaccttgaactcctgggctcaggtgatcctcctgcctcagcctcccgagtagctgggactagagccatgcaccaccctgcccagctaactttttttttttttttttttttttggcagagatgaggtcttgctatgttacccaggctggtttggaactcctggcctcaagctatcctttcgtgttgacctcccaaattgtgaggattataagtttgagccaccacacccagcctcagtttcacagtttaattatttctgaaactgtggttcaaatatttgaaattattatttttaaaagattgggtaagagtttaacttttgttttacaagggatatatatgtatatatacatatttggtttggagacagggtctcactctgtcacccaggcttgagtaaagtggcatgatcacagctcactgcagctttaacctcccaggctcagatgaccctcctgtctcagcctcctgaataactgggaacacaggcatgcgccacaatgcctggttaattaaaaatatatatgtatttgtagagacagggtctcactatgttgcccaggctgctctcaaacttctgggctcaagtgatcctccagcctcagcctcccaaaatgttgggattacagggatgagctactgtgcctggtctacaagggatattttaataggtatatttaagaaaaagacttggacatttagtatgtaagcattatccttcaatgtagagtagttataaaaaataaaactaaaatatttctatgcaggaacaccttgtcaacagtcatttcataactactttttattttctgcagcatatattattttggtgctagtaacattgatgagatgtgactgtgataagcatgaagaaaaaacaaatgggacaatattagaaactgaaaaccaaacgaaaacactactactggtattgtattgaaaacaaatcacatgaaataaaataaattgaatagccaaacttaagatctacatgcataaaaagagaaataaattaacattatttttataacaaaagaaatgaaatctataaaatatgcaaatagctttatcttttaggttcaataaacacttatttatacttcctatatgatatgcttttccacatacattatattgtgtttccttgataacatttttactgattttaaaaagtagactgggcacagtggctcgtgcctgtaattccagcactttgggaggctgaggcaggaggattgcctgaggccaggagttcaagaccagcctgggaaacatagtgagacccccatctccacaaaaaattaaaaaatcagttaagtgtagtggcgtgcctctgtagtcctagctactcatgaggctgaagtgggaggatcacttgagcccaggaggtggaggttgcagtgatctgagatggtgccactgcactccagcctgggcaacagagcaagaccctgtctttaaaaaaagcaatgtatgtgcatgcatggagtcaagatatatatgggaactctctgtactttctgctcaatttttcggtgaacctaaaacttctctaaaaaataaactctattaaaaaaggcaatatatacttattgtagaaaattaaatttacaaaggtataaagaagaaacttaacataacccacaatcttaccacccagagaccactattgccttttctcttttagttttttctgtgcatatatatttataaccatttaaaaaataaaataataatcatgctgcagatgtaaagtaatttaagcatcctatacctacagaaatagcaaaatgttaacaccagaaattaatgtgcctttcagcaataaaaaaaagaatatattttgttaaccgtatggtcaaataaaaatttattttcacaattggtggacacgcaaagcagttgaaatagtctgaaaaaaaacttggacatatataattaaagtgacaaacacatctcttttttctctctctcatcaggatctaagccaagaaactaaaaataaaaacatgaatcaagaatgatcccaacaaccatgctggaaactaaatatttcatttttgtttcactaaagatgtgtcattagtgtaactaaggaaaattatactctaattggaaacacaacatgaaaaattatactgtattgaatcctgcacacaataaattgaaaaatgaaaccatgaaaaaatgcacagaaaaaagcaaatgcgacattatacataaaaataagaatatgacacactgaaaactataaagtattgatgaaattgaagaagacataaataaataaaaagatatcctgtgttcataggttggaagaattaatattattaaaaagtacagactacccaaagaaatctacagctttaatgcaatccttgtcaaaattcaagtgacaagggtcacagaaatggaaaaaaaatcctaaaatttgtatggaacctcaaaataccccaaatagccaaagcaatcttgaccaaaagcaacaaagctggaagcatcacactacttgatttcaaaatatactacaaactacagtaatcaaaacagcatagtactggcataaaaatagacatttagacaaacggaacagaatagatagcccccagataagtcaacacatttatagtcaattgatctttgaaaaagtgccaagagcacacaatgaggaaaggacagtttcttcaataaagtgcactggaaaactggatatccacatgtctcctttgaaaaagaatgaaattacaccgttttctcacaccatatacaaaaataaaagagattaaagactgaaatgtaagacctgaaatttaaaactactagaagaaaacataggggaaataacttcttgacatcagtcagggcaatgatttttggactatgacttccaaatcataggcaacaaaagcaaaaatagatgattgggattgcatcaaactaaaaaacttctgcacagccaaggaaacaatcaacagagtgaaaagacaacctacagagtggaaaaaaaaatttgcaagccatgcatctgataaggggttaatatccaaaatatataaggaactcaaacactcaatggtaagaaaacaaataactcaataaaaaatgagcaagggacctaatagacatttctgaaaagaagacaccaatatggccaacaagtatataaaaaaatgctcaacaggcttaatcatcagggaaatacaaattaacactacaatgagatcacttcacacgtgttagaatggctattatcagaaatatgaaagaaaagtgctggcgaggatctgaagagaaaggaacccttgtctattgtttgtgggaatgtaaattggtacagccattggggaaaacagtgtagagtttccttaaaaaattaaaaatagaactaccatatgatctagcaatctcacttttgggtatatattcaaaagaaatgaaatcagtatgtcaaagagatatctgcaatcccgtgttcgtcacagcattattcacaatagctaagatgtgaaattaacctgtgtccattgatgaatgaatggataaagcaaatgtggtatatatacacaatggaatactattcagccttaagaaagaatgagatcctgtcatttgtgataatgtggatgaacctggaggacattatgctaaatgaaagaagccagacaggtacagaaagaccaatactgcatggtctcacttatatgtgaaacccaaaaaagttgaactcatagaggcagagagtagaatgatggtggccaggggctgggagtgagggcagtggaaatatgttggtaaaaaggaacaaagtttcagttatgtaggatgaataaattctggaaatctactgtacagcatggtgactacagttacagtattgtatacttgaaaatgctaagagactaaatcttaagtattcttaccaccacaaaataataagtgagttgatgggtacgttagttagcttgatttaatcgtttcacaatatgtatatatatatatatatattacaacatcatgttgtatactgaaaatatatacaattattttatttgtcaattataccttaataaagctgaggaataagtgagtatataactatgtacctatcagaatggctaaaataagaaataatgataacaatgcatgctggtgaggatgaatatttggcacttgtgaaaggtgggggtttgctaatggtgatagttcaggaattttccctggagactcttcaaatcagaggtagcaggcctttatacacatgtaattctatgatttttccatatgtgggaaaatttatatttggctaaatgtgcagccagctgcttggcaacatttcccaggagagctgggattgcagtaaaaagtgaccatttctggcactgtttttggaacaccctagattggcttcaatggtttcaaaggaacatttttgcacaatttcctcaaaattaattatcccaattcattttataccaaagataatttaaggcaggaaatgccccctgaaaatccttctatctaaattgtattttatccccagttcttcctccacaaaaccgtcttagactcacttggcccacagtgagctcttcctgtgagaattcctcctgtatttatgatacaagttcaggtggcctttcagaggccatgtaatttagcacattcttctgggtctatgttcttgctccgtttgtcagcgattggctctctccccaatcaggctgtctactccttgagaataaggttggtgtcagataaccttagtcatactcctcccccagccctctcagtgggttagcatagtttagaaccaaacgtgtgttcaaaaacatgcaattgagaatgggcgtggggatgacataaagtctgtgtccctgtaaagcgcttaaaaaatggcttcaagagctccttgcacaaacaccaattgcaattttctcctggatgctaaaaccatgtgtacattatgttgggctctgtatttaaccagcctgaagtctagacttatcttccctgggccctcagccagagattacagagaaaaagcagccttgggtgaatgtcttgtttggaagcggaaagaccttgttcaagtgttggtgtaggaacagcagcagacaggagctgagctacctccctaccacccctcactggggagtgatcagtaaaaaaggaaatttctatgcacagtagattgtgagattgtgctctattggcagctgctgagtagtagtgctgagatagaaaccaaggcaggttggatccacaagctgtgctctcaaccactaggttacactgtctctgacgatggtcccctgttaatgaacatacttgctgtttctggttttcaaacatttgcagtactcttccttcgttcattgagcagggactctctctctctcttcttatctgtcctatctatcttttatctgtctatctatctacctatctatctatctatctatctatctatctgtctttttttttttgagatgtagtcttgctctgttgcccaggctggagtgcaatggtgcgatctctactcactgcaaactccacctcccgagttcaagcaattctcctgccccagcctctcgagtagctggtatcacaggcgcgcatcaccacacctggctagttttgtatttttcagtagagacagggttttaccatgttggccaggctggtctcgaactcctgacctcgggtgatccacctgcttcggcctcccaaagttctgggattacaggcatgaatcactgctcccagcatttttctttcttttatctgtctatcgtgttccctgttatatccccggtgcctgacaatggttgctaaggaaaagttgctgaaagaagtccctcttgtatccctacagtgctctgtgattgcctctgtcattttacttaccatgctgtgttgtatgaggtggggctgcacttatttcagacatttctttgtttcatggaattttttaaatgaaccctagtaggagggatgcatccatacccctcaatcattttagtgatattgtcaatgtcttttggccaaagatcactaggcacacacatgttgatcaacctgggtttattacttgttgaagtgagggggcatgtacaccgtgaagaactgtgaggcatctcaagaacagtatgttagaaaagatttgttataggatttgggcattggctagatgactgggggaaggtcaaaaaaagctatggtttgccctatattggatgctgtcagacagtagaacaattctgtgatcaagtatttcaataagttttagctagagggagggtagagtagagggaagctacagctctagttagtaaagagtagcagtcattcattttagctgggagagggatgttttgtcatttctgtggtttggacagtgttcacattttgtctggtttcagccattacagagttatcttgcttctgccttgatccatcatagtcacagagttgccttgtctgatattggcattctgtggatttatgttcaacagaacaacaagacctagtttggtgttgctgctagtgctaggccagctcctagcaacagcaaggcctagctgatggtactagtccaactcctggatggtaggagatgcttttctctttctcatatgagtattttaccagaagggcatgtgcagggagctaccttaagtgcatttcaaataggctcctgaatacctccatccatcccacaggtgttctacctccaaagccctgttctctgaccccactgcattgctctgtttccatctatccaacccctgctctatttctgggccaagtcctacctcttctacgaagacatctctgaccactccacaccaaaatactttctcactactctgatctcggtgcctttactgtttgatctgtttctttgacattttctggttatatcaagactctccggctcactaccatatcctaaggcctaacactacatatggtctagtgaagcggtagcatgtactgctatttaacctttaatgcataggttttgtccccccagctgaactccaagctactcgagggcaggaattatatgctgaggacccatatgttgcttatgtgccaggctttgttctaagattttacatatattagttcatttaacactcacaacaagcctatgtgataagtgctcttattatctacatttttcgtattttaaaaaacccactgaagttcagggaggctaaataactacccaagatcacgcaggtactaagtggcagagcttgggttaaaatccaggcagttcagcccccgagtttgacaaattctttgttttatattcacagcagggacatctggaattaaaacgtaccatcctctggagaaagtcatccttattcattttttccctggacctgaggtgcctctcaaggagttggagaaatcagaatctccctaatagagatgagctcaagggtaaaaaaaaaaaaatgtgatggataagatctaagcttactacacagataaatgactgcatattacccgcataccaaagcactttttcctttacaaaacccttgcctgcaaattccttcaaagagaaagcaccctaatgcatttcaaataagctctctgtatgcaacatttcccttttcagccctcccgcatctctccccacccgctccaactgtcagtggagtggcttgagtgggaactgctataggtttttagaacttatggtagtgaatgtgtgtccttttaacttccagaagactctggaggtcagtgggctggtgaggcaacctgttgccaaacagtgccaaatggtcatttgaagctaaaccagcccagaggatgagctgtgggctgtactgcaaagggagttgtttggttgttggcatggggcttcctgaactagacctgtcaaagagcccatggagctatcttgaaatgttctttagttacagtcctttacagtagctccttcaattgccccatcgatagccctgccatgagaaacaagaaccccttctgcaagccatttggaatatagaggaaggggaaatcattatctatctatctatctatctatctatctatctatctatctatctatctggccaagagtggcctgatttttgttctcatttctttgaactgaggtccactccgttataaccttgctttgttctttcccagtcctagactgccatagatagtgggcttgcagctttgtatggaggcattcattgggcaccagtgcactgacagtctctgaagaattattaggtcagctggttccaaagcatttcaggctgattaaggccctggaagaatctttttcctagccccttctgttacctcttccgtgccttcccctccagttcactcagaggctggttcatgaccagttgcaaaaagcagggtagtagcgcatacgaatcttctctctaaatcctcttcagatgtatttcacttataatacgtgttcttgaaaatatgcattaataaaattgtgtttgcttgaatagagaagctaccatcactgtgtggattagaatggcattggtgtaaaaatctatgaagataatacatgccaagttagatcaatgcagtttggtaggtggtatctccttagatcctcacaatgccacccttatcctccggttacaagtaaggaaactgaggaagagtgattcccagaaaaagaagaggaagacaagataaagaggtaaaagataagagaagaaaagtacgggaagttttgggcagaaggtaagaggatattggtagagctttgtgggggtgggttaggagaggtgaggggaagcttttaggtaaggacagatgtccttattgtgaatctggaagggcacagaaaagaaaccaaaacttaaacatttctggaggcactgcctgggccaccctcctggaatgagaagatctgaggtcagagtagctaaaaaaaaaaaaaaaaaaaaatccttctataaattatgccttctcttggagcgaagtgcgacctctactctgaaacagagtcatacagcaccactcagtggcagtctctcggtagtgcaccgagagtgtctgcagcagccacccggacccaatgaatcagaaccttgaaagacagaggagaggcggttatgttattttatttaatccccacgaggttttgatgtgatgccacatttgagaatttcaggccaaacttgtgctttctctatgatatgaagactttttaatttaatccccatgagattctgatgtgctgccacatttgagaatttctggccacacttgtggtttctctatgacatgaaggctttttctgatgccaatcagtgtggcaggaggcacctgggcaaagcagaacctagaccctctctttgctctttgcattctcttctcaggagtttccttctttctcatcaactatcacttctcagtgcatgattatgtattaggtgctgtggtgatatagcatggcacaagacaaacaagatgtctgttctcatggagcttacagggagaaagacagcaaatctatacttacagatggtgataggttctatgaaggtagtagacagatatggcagtgagacagaaaataactgaggtcagagaaggcctctttgaggagttgacattgaagccaagacttgaaggttgagaagaagccagccatgggaagagtagaagcaaggtcttgcacaccaaggagcacagcttggcaagaggactgcaggctagatttcggcccaccctacacctcagctggatacctttgtgtagagaacaatctgcacgatcttacatgagagtagggggtaaggggattgttccagcagatggaatttcatgtgtaggcaagaacatgtattctagaaattatgagaacagtgccaggaaaagactagatcacaaagggtcttatggggtaagataaggagtttgtatcttatttaattcacaagaagccagtgaaggtttttaaacaggatgactgaaagatatgaattatattctttaaaaaactctctagttgtgcagagaatccactggaaggggaaaaaccagttaggaggctattgagtagtcaaatcagaaatgctaaaggtttgcattagaatgagagtattaatagttgaagagatgagaagtggacagatttgagagacgtttaggaggtaagccgacagatggaatggatgtagaaaagaattaaagagggcaaccaggtttccgatgaaagcatcttggtgggtagaagtgccatttcctaagaggaaagaacaagcagagaggaggagcaaatccagaatgacattttagctacttcaagttggagagatctgtgagatactcaagtggagatgccaagtcaaatttgttataaacttggaagaggggtttgagacacagatatcaatttggaaattataatcattgggttatcttcaaggccttgaaacaaagattagatcactgagggaagggagtatagaaaggcaaagtcccagaacagagcccagagaaactctagtttgggggaatgaggtaaagagtggccaaagaggagaaaactcagaaaactgtaatgccacagaaatcctgaaaggggctgtttaaggaagagtaatgtgggtagctgctgctgaaggatcaagaaaactgagaatagaaagagactgatggctttgaccacatggtggtcattgcagaccatagtcggagcaagggcaccaaactggaaaaataagaagtggtggtcagagtgtggaattcttaagattttttaatcttgagattttgggagtgatgtatattttcattaagaaaggtctaggatccttggcatggtcctgagagtaagtggatgaggtagggtagatggcaaattattggaaatgtagaagctgagaaacagaaacgtttgtgtgttcaatggcaaaattgtcaaagatttagggtggagggaaagtgtagtgaaactgtggttgccaagcagtcttgagcgtgctcatgaccacaaatttttagtgaatttagtcaaccaactttcaatatttttatctgcttcatttagtggcaaggaaaaagtaatatagtgcaattcaactagagtttggggttttgcctagtagatatgatagacagctaagaggagaaagggaatggagtgagtgagtaggtatcagtttcctattgctgctgtaacaaatcaccacaaactttgtggcttaaaatacagacttaaaatattagagttgcagaggtcagaagtgtcattgagctgaaatcaaggtgtgggcagagctgtattccttctggagactctagaggagaatctgtttctttgacttttccagcttctacagcctgcccactttcactggcttatagtttccttcctccatctttaaagccagcaacatcaggccaagtctttctcatgctgccatctctttggttctctcttctaattccctctcccacttttaaggatgcttgtgactgcattgggcctatctgactaatccagaataatctccctatcctaaagtcaactgattagcaacactaactccatctgcaaccttaattcccctctgccaggtaacctaacagacccacagggttctggggattaggacatgggcatctttggggaggccagcattctgcctgtgataatagcaacacataatggatggaatttaaactgggtaagtaggcaaatgaagaagatggtaggaaggtagagtgaaaaagtggctaggtcagcagattggggaaataatctgatgggattgaaacattgtagcagtagagaagaaattttctaaatggtgccatttctggtaatggaaaaggctagtgtaggaccatgggggtaagtatctgatgtaagtttgtagaaaagatcagatgaggaggtcacggaagtggaattccaggtcatgggataagtcatccctgtggatgttaaagtcacgaagaatgatgaacaaacttcagtgtaggaaagaagactgatgatgcaagaaaggcataaaccccacaagctagataagcctgtaagtgaaaaggagcctgtggtggtgcagacttgcccagaatcagaaggatggagccctgacatgcaactccactcccaggggctgagctcaaagttacagagtctgtgcaatgacccccttgggatgtggaagtcaaagtcaaatcccaagagagaccagcattccagactgtccctcgcccctcccgtggcttccatgagaagcaggaagtgctgggcttgaggaccgtgggctctacctggcctggaaggagatggcactcctgtgccagagtaggcacaaagtaggcacccgcagcctactctggctgtgacacagtagactaggaggcaagcaagggaccaagtcactccctgtatgtcaagggtgggggaagggtctcccatgaggggtgagatccctcattgtccccagcctcacagcagaatcacactaggttgcaagagcagaaatctcacaagaggccagggagacgatcccaagagagaaaggaagaggggatagcaaggccctttgcagacagtcaagccctaggcagatagaagagaaaaacaccattcatggtgatagtgattccaaagccgtttgattcatttagcaaacatttatcaaacaccgacctggtgcagagccctgtggcaggcaccgtgggtgttaacaaacttgagacaggcctggacattcaccctaaagggcctgtgctttcttggaggagctaaaccatgtccacacataccactgtcattaaggatagtgtctggtgagggtggtggggtacagatatagaaaagtaggctgcctggaggcggtgagttttgagccaggctgtaaaggagatctttgggctggtcttccaggggtgttccctgtcatcccaacattaagtggaaacctctgagggttgttgtggctttaggtctctcccactggcccaccttgaccttgatggtgggtctgcaaatggaaaggacttggccacttctgttgactgacagagggaggtggggtggggaaagagagcacctttccctaagaaaatctgaaatcctgggttgtgccaactacctggcttggcaaagatcagatgtcatgggtgggatagctggagataaaggaaaggtagcaactacacaccagagataagggaatgtgacatcctggatgggtctacatctgcagacaacaggctcaggcagataaccaaggctatggagattgttccacggacttctggctcacatacttgccatgaagagagccccaatgcgggagctaggaggacactctccctcagtttcacttcaggtagtttcacttcacttattgaaagcacatctgctcagctttttcctttctcttctgtttgctggtgctaactagtttcccctcccagggacttgaaaacaactggtaagatagcttactgccactgcaacagaaccatctcctccaggatctgcctcactccttgacaacaacttgctccataacaagcccagtgcccagttctatctccctgcagaaagaagcagctactgctgtgtactttttgccctagagactacaagattgacagcagtcatcacattgtgtttcacactcactgataagtggacaaggcaactaaagaggaaatgatttagtataaactggagtctctgcaaatataggaacgttgacactctatgcagctgggaaagctcagcttccagaggtcttagctaacctccaccccaaagaggggcacaggaacgatgggggaagaggcactaggatgtaaaccatgagcagtctgtcatctttggatttcatcagtcaaacaagcaagaggtacaaatgacagttgtaaggaggcatggcattggtacatgtaacgcactcaataaatttggtaaatgaataaataaatggtttaatgaataaggttgatcattttaggtaggaggtgaagaagatcagag[145 bp omitted]cccatctctactaaaaatacaaaaaaattagccgggcatggtggcgggcgcctgtagtcccagctactcaagaggctgaggcaggagaatggtgtgaacccgggaggtggagcttgcaatgagccgagatcatgccactgcactccagcctgggcgacaaagtgagactctgtctcaaaaaaaacaaaatggtggtacaaagaggagtatgtgtcctatggaaggcaggaaacctacttagtgatagtaattacataatagtcttgatattgcttctggaccttgcagaacctaaaatgtttcgtctctgccctttacagaagaagtttcaccaatccagggtgcctccacattggatcactatagtgctgctaataatcgtaaaattaaaaggacaggacttgtgtggacctaaaggctagccctggacactaaggcctcaaagaaaagatagagttctggattctgagttgtcctagagcttaagggccttgatattcattggatgcagagcatgtcaatctgatgttttcagcaaatgagcttagagctcactgagagcccctccttgacccttcctgtcccgccccctgtcacttaccaacccgaatctttcccgccttgtctaagtcctctcaggccaacctcagcgggaggctcctgggatcggctccctgcccttcccaccttagggtgtcctcagagacagacttttattccctcagtaaggagacagactcttattctctcagcagcccagcccctcacctcccctcagccacagccacatcagtggccaccgtcttcaccgttgtcacctcagcctagtcgccactccagttgaggcactgactggcgtcatgtctgccacaggggatcaagacctgatccaagaggaccaggaggctccagtgaaccaggagggagcgcaggccgaggccgtaggtgaccgggagggcggtgactctggccccgacagtggcaacactgtggccggagtcgcagggcccatgagaggcctcggggaggaggagggtgagcaggcggcaggcttggccgcagcccccgggggtgggaacgccgaggaagactcagagatcaggatagtagtggagatggtggaggaggaggaggatgaggaggaggaagaggaggaggaggaggaagagaggaacgaggcggacaacttcgacttggtcgcggccgcccgtcgctaccccataagaggctttcgcatggagtttctggacatggtccactcccttctcctccgcatctatcacaacgaccacatcctgatcaggatgcgtggcggccgcctgatgcggaggcgccgcactgcggcgcccagtggctcagaagagccccggctgttgctggtgcatgagaggctgggcgtgggggccgcgggtcctgagggcgagggcctgggcctgctccaggaggccgcgttggtcccagagcctgaggtgccagcagacctggccgagatggccagggagcctgcagaagagcccgcagaggaggcctcagagaagcccacagaggaggccgcagaagagcccgcagaggaggcctcagagaagcccacagaggaggccgcagaggaggagctcgcagaggaggccgcagaggaaccggccaaagaggaaccggctgcagaggaggagtccgcagaggaaccggccacagaggaggctgctgcccctgagggtgaggaacaggctatctgcagtggcggggagacagggacccgtgcacccaagggttccaggcagggccgcggtgtgcgcacagctggtgaagcaggtggtgaagtgggggtcgggcctcgggtggtgaagtgggggtcagggccctcctgaaacttaaggccaaatgtgtaccaatgagtcgaagcccaattctctaacgacatctatgatttttgagaaaacatgccgccctctaccaacctgtgtttgatagaagatctgagatcatcaatgccatttggggggcccacagatgaatggccaggtagataggggttcaggagggagctcggcaggaaacaagggacaacggaaagaaaagaacaggcaaatggcaggcatccttttttgttcatggcttttcaaagtgtaaagattcttagaaagttgatccccaaatgatgaagtgatacaggggcccttggtaaaaatgaaacattcaggggggtgaggaaccaatgagcttcaccatagaatttgtcttttgaggcaacaaatattttcccagcaaagttctgatcaaaacacttagaatgagatcagacaccatgattctgatctcttctccaaagaactagaaataatcggcagctttgggtgggagatttactggaaaaaagggaaatagtgtcactgtggaaatgatcaagcagcagcaacgtgagggccatggcactgttgtgaaaaccagtaggaaggtgcccagctattcctttcttagttaagtctatcctcctgcttctcctgagggtggagtactgggtgccgctgctggttataaattgggctatattttctgtgaatgtctggtcccaacatctgtattattcttcgctaaagaagtcactaaatatcagcatgaaaagtgggatgaagaggcccaagatgctgcaggcaaggaagagaaagaagagaaagagaaggatgctgaaaacaaggtgaagaactccaaagggacctagacgcagcagaggggaagctgagaaaatccaggtatcggtgtatagctttgagaatcactcaactattcctggcatttacctgttgctgacagttttattttaaaataaaattcccagtaaattaattaagaaaaggttttagtttaaaaattcaatttagcttacttaaaatgttactagaatattcatgtacgtagtaatatgaactgcagtgtgttctgaaatacacttcatggctactcatttgttcatgttgaggtcttttgtcctctagctgcaggactactaacaagtggcaaatgtatcagacctactacctaagatcaatatttgtgtagaaaacagttgccagacgcagcatctaacttgcttgggccacacattggttgggacttcattacttagccacagaaatgcaggctcccatagtaactaggagacaactcaatgccttttacaaagtgactactaacaaatagcaaaaagctaagaatttcaagtaggaccacatttaatgactaatacctaaatatttgtttagctatatatctttgtattttatgtgacaaatgaaaagaatgtgtgtaattaagtcttaaggcatatctgtctttgagtatatttaaatggttaacattttttcttttttctttttttttttttttgcattttcacagctgtattatttcataacagcttctttcccatatggtagatatggaaaccaagggtctgggagagtaagggagtatcatttgtggaactagcacaggctgttaaagcttgagagatttatttaaatcccagaattgcctctcatgtaaaaacaacaacaagaagcttttctggtgctagggagacaaggttggtgtgatcatttggctgtaaccatcagtttcacaagcaccctgatatccaagcttgcgagttacaaaaggaaaaggtgttcttctctacttgtttaagatatagcacacaaatgttgcagatatacacagagctggccattttcttctatttagaaagtcactggtgctggctaacgtaccattgtttatttttttctcatttcattctgtagttgggaagaatagaaagaagatgaagaaagaagactctgttgttcattgtttttattttattttattcagatgcctgtgagaattttaacacatatcattccaaagttcattaccttaaaagtgatatctagtgacatctaacttttatctttcacaaatgtatttgacagtgtttgttcaagttagaaataaaagtttgttttaaatgaataaattgaaacatggggagatttttcaataaataattctgactcaaatctctcttttacctctttgttttggcccaccataccttcattgaaaggtattactttccaccatttagtaagactgttttaaattcttttactgcagccaaaagtcaattaaaatgtcaagtttaaaaccatttttgcaaagagagagatggggctcaagtctttagagctgtactgtctactaccttagtcactagtaacgttgtggctgctgagcacttgtaatatggctagtctgtttgatatgtgctgtaagtgtgaaaataatattgcatatcttactaatgattttcatactgattacatgttgagatgataatacttgaattaaaatgaaatgttaaagtttttgttggtttctttttattttcaaatgtggctactagaacatttagaattacccatgtagatcacattacatgtctattggacaatactgctctagagcatggttttgaagaaaacttcatggatggcccaggttgcctggaagccacatggtattgctgagcttgggcccagactttgatttggagcagtggttctcaaagtttggtccccaaacagcatcatcagcattacctgggaattctcagactccacccaagacctacggaatccgaaaatctggggtggggtcagcaatctgtgttttaacaggccccccaggggcttctgatgaacactaaggtttgagaaccagtggtttcaagcaacagaggaagaagccgagcacctcctgtcgagccagggttaattcactggctcggggctgtttcaggtaaactgaaagggacagcaagggatgggctggggaggagactagaattcacaggggctgaggcctagagaggaaaaatgcataaaggaaaaagtcgggtccaaaaggatacaaacatgataccatgcatatgacttctaagaaaacatacaaatgatcaccataaattgattatgggtacatatagagagactaaaagatgtgcttgtaagagatgcatacaagtgtagcatacagaaaggtgtgcattcgaaagaagcacatttgagatggtggttacctctcagggaaagaaagggaggggcattctagcagagaaggctccacagcaggcatcaactatatttgtaatgttacatttcttaagctgaatagtagatatattgatgtttatagtaacattttctacaattttgtgtaggtctgaaatatttctaaagcaggaggaggaaggggagcagttcttcccacaccactggggcaggacttacaggagtctgagaattctagaacccaacctggcctttgaggtcattatgaaggtacatttgtcatggaaggagataaaccattaaataaaacatgctgtattcgtttatttaaacatttcaaatatttagacatatggtatgtggatcccaagttgaactcttgttctaaaccctgaaaatgttacaggtgagccaggctcattatctggcctataacccctttcccttcctccctccatgccactttgttacctgagcacagtagggccccttgcttctgaaaagcgcttgttgcagtagcccatcttgctatcggacttggactttgtccctgacccaggctacagtgcaaccaccaatcaccttgtctcttctgctcgtcccccaaccacaccccctctttattctccaggtgtccaaacgtaaaacctcttcagtggcccttctcccccataccaaatatcaatgctcacctgaaagccatcagcttggtcaggcacacctgcgtggacgcc[138 bp omitted]cggtgaaaccccatctctactaaaactacaaaaaaaattaaccgggcttggtggcgggcgcctgtagtcccagctactcgggaggc[136 bp omitted]agctctgagttgtcaatatcctatttgatttcccgccccatgtcacagacagagatggactacagaataggctttattgaatttatttgctttgcatatatcttaaatcaaaaaagttaaagaagtagaaaagttgtcagaatatgcctttaggcatttaaaaagaacttaatctcttcatttaaaaacagaactttgttgttaactgtggaaaagaaattgttattggagagttctcagagtgagaatagctgaatacaggttcactgtgaaaaaaaggaagggaggtgtaacagctgtgttgttaactgtggaaaagaaattgttattggagagttctcagagtgacaataactgaatacaggttcactgtaaaaaagggaagggaggtgtaacagctaatctaccaggagtacccagataaagggcatctaccttaatatattgttcactatgggaatacaaaggaaataaaattcactcaatcaaaatagcattatcaaaatggcaaaggcacagtatcaggaaaaatagatgttatatagagaaaatgcaaaatttagcatgtaattgtactgtgtcacattataccagcatcaacaaaacccagcaccaagtgtttagctctgacacctcactacctctctggatttttttgcatggggcagcaccccactcagaatataaaggcacagtcagatgtccaggcctgcatttctgtttaagcaaagcagcacagtgtaacagaggcagacacagtgataactactcagaagtcacttctgggtctcctagaaaaatgagctaggtttactgcccagacatccaaagggagctctcccttagtgtttggtgggtttgggggatggaatgaagagaaagacagagaaaggaagatttaactaacttctagtgaacctagatgagattctagggtggtctgcatctcagaaagccagccaattaaggaactggctctgggggtaaaggtgcctacatcttcatcctcagccgaggagttattaatggaggctgtgctacaaaagaaaaagaccgtgtggcaagatgggaagggaggcatcaacatttgctgggccacttgccccctcccctcacagctgaccatccctctcatcctctttctcactctccctttttggtcttccctcttctccgtggctgggggatgagtgggtcactggaaggtagggtctctccagcctagtaacttttgaggtgtgtgcctctaggaatgagaggggaaaagctgatttactcacttaaagcttccaggtagcggaaagttcatttctctgtggctttgggattgcactcttgctttgggctaaaaccttgtgaagcaaagacagctgaggggaaaggacaagaagctacatggagttctccaccttaatgctggaaccagagaggaaggagctccagtggctccagatgtgcatcaaggcagtaagcttgccatctgcctgatggaaagtacagcttttggcatctgtagaactctaatttcaatagggtcttcagtgcttaacaggatatatgtgataggcagtgatttctgtgcgatcagagagggtcacagtagtattgggacaagaagcaaaacattgatggactaaccctccagaggagtaagataattcccaagaagcattctgcgtcatagggaggtgctcgctacagccaggcctgtgacaggtcgacgtggggtatgtccaaagagggagctttgtgtaagtgctctgcatgttactatcacccaaggagaaagcatcaggggcccccagggacacagggaagatgtttcaaggggtgataggctgattggagaactggctgtgcagaaattttcttggagacccagaattttcacttccaccgcctcttttaggatcccttgcaaagcttagagcaacaaccaaataattgcggcatctatctaggctcataaaacctaaaggccaatctttaggtcaaatcatctgaatgtttccattagaattactttatttggttgagggaaatgacaattttctagttgctccaacaaaatgtttttgctttctcccttctaaagcacattgtccaaagttaaagattttgcaattttacagcagtgcaaatgttttcgatagttttaatagaggaaatgctgggtttctgggtgctggcagtgactacgtggaaggttaagcattcatggcatttatttcattcaaataattatgttttaatttgcatttctaaggctattttgcttaataaattcttattttgcttaataaattcttagtttgcttaatacttattttgcttaatacaagtggtcacagtaaaaagatcactacatagaattaatacagctattagcaattatcatttaaaacgctgatgcttggccgggcgcggtggctcacgcctgtaatcccagcttttgggaggctgaggcgggcggatcacgaggtcaggagatcaagaccatcctggccaacatggtgaaaccccgtctctactaaaaatacgaaaacaaaattagccgggcgtgatggcgggcgcctgtagtcccagctagtcgggagactgaggcgggagagtggcgtgaacccgggag[143 bp omitted]tttctgccatgtggctccatgctttggctttcttcctggccagtgagaaccagacaggctcaattggctcaactgggttctggaacttggctgggagagttgaagatcgtttggtttctttttccatggcaggaacttgcagtatcttctgagcttcaaatccaactggaaccacagcaaataacacacaagcaataaggaaccccagcgatattggggtatgttgtttatggaatgccatataatgtttcctcctttcaggtttcctctgatccccctgctctagtgctttctaaactcttctccctttggtgccagacttctaaaagttaggacctgtgtgatgccatgggtagtatgtcaaaggggtaaaatcaacttggctatggccacagggccctgggcatgggaaggcctgggaggtaatacctatggctgtaactgccaatcttcaggtggttattactggattgtcttacatctttgaactgagaccagagggaaacatattgtatctacttagtttctaaaatttcagataaggtaatgttatttgtgtttgccaatccacgatttcatgtgaaatgaattgattgatgacttaatagatgcacccagtaaaagttgatgataaataatattgtaccaacccaactaccccagccaaggagactacctccctattcctaattccactccctccctcatcctgcttatggtcaattgacttagtgacttagaatcaaccagtggttctcaatcctggctacacattagaatcacctagggctcttttaaaaacaccaaagcccatgccgtttcctgaagcaaatgaattagaatctctaaggatggagccaggaccatctgtaattttttaaaaagctcaccaggtgattctgatgcacagtgacagttgtgattcacttgataggagtatagtgcccatgaggccattaaaagctgtgagcaagtcaactgctgctatttcatggccagaaaatgggttcctgaattcctggtctaatttcttcatgagcgggattaagggagaggacaaagatggttcaataaaaatccatcatccactcccctgctcctgctgaaaaaattctctctagcacacaattctttctggtgagatcacattctattatatcccagcagagtattcctctcagctgtcaacatttcctcaccacttacacatccctgctcagaatacagagaagcttaaacaagccttctaaataattaaaaacaattgaataccattgggcctttagagtgaattattttcaacagtttcattggagatgtagaaagtgagaaaataccgctttgctatgaactggaaagtgacttggtactttcctcttgcatacccagccagaagaatgtttcagtgagtgaccacagttttgtgcctagacagcttctttgatgaggcaaaagactggaagaccctctgaaagttatacactggacttgtattagtcaaaataattagattttcctaaaataagctaatatttgtatctaattaaagagccacgcgagaaatcattaagctgacttaaggtaagagacaagtattatctgagcttgaaattgcaaaagttttacaacattctgtcggggctgttttttgagaggtcagaatgtatgcttttacctgattttgtaggcttaggtggcttcatctgtgctgtcttctcctgtttatggacactggaagtgaacatctttttaggttggttttcatttgcagagccagctccctttaatacaaaaatgaaaacagaaagcttgtaagttctgacattaaaatggcagattgcttattcagaggaccatagagtgcaagccctgtcctgggtactatgagtttaacagtatccaaaaggaaagagattagaaatatagagatagataaggagagaaatagcattgagccttttggcttaaaatttaggttcacaaaacctaagctggctcaagtttaccacctttcagaccagaaagaaagagctgtctaattttacaaatagtgaaagcaggttaacaagataattatttaacttgagaacaaccttttccttagcactttaccagcacttaacagcaagctaacagaacatggtagttgcaaacaaatctgatcaattcactgaagtgagttccataagatttctacttttcaaaactagctgacatatgacttgaagcatttctcacattagaaagtaatataactgtaggtctttccaaaattctgcagtttattcttttcaaattaacctcttcataattggtctaaattaatgagtttatatacactaatgtatccctcctgacaaaagctttaaccaggctgagagcagtggcctataatcccaacactttgtgaggctcaggcaggaggatcacttgagcccaggagttcaagaccagcctgggcaacacagtgagacccatctctacaaaaaattttaaaaattacctgggcatggtggcgcacacctatagtgcctatagtcgcagctactatggcggggatgaaggggaaggatcgtttgagcctgggaggttgacactacag[132 bp omitted]taaatactaatgatgaaaaagaaaagacctttaaagcaaagagttaaacacctcctcgcacagtccttcaacaaatttagtaagcacttaaaagtataggagcttagacatatctcttgatatatgaatttggtatgtttccttgagtcagttttctgcaggtttgataagaggggagaaaggcatcatcccatcatctcttatccacatgtggtagttagcctagtttaccacatcacattttataacttacaggtaggtgccacaccaaaccaaatcaatatgtagaaatccaaacatcaaacacagaaagggaacttgttgtgtactgatacagaaaagtgcccagaaataaaatgttaaatgaaaaaaacagtatttaagtttgattccatttataaaaatatatatacatattgataggtataaaatatctgtaaagatagtcactcaactcttaccccagtgattacctttaggtatttttttaagctatgaggatgcaaaggcataagaatgatacaatggactttggggactctgagggaaagggtgggaaggggatgagggataaaatactatgaactgggttacagtgcaccaaaatctcacaaatcaccaccagataacttactcatgtaaacaaataccacctgttccccccaaacctatggaaataaaaaattaaaaataaaataaaatgacttactccttatttctcaaccaatttcgtggagccttgctttagaatattgagggcaggatttgttttgcagattctctctatgttcatgactttgcacaacacccccgcacacacacttttgagacagggtctcactctgtcacccaggctagagtgtagtggcgtgatcttgactcactacagcctccatgcctgggctccaagtgatcctcccacctcagcttcctgagtagctgggatgtcagcacatgacaccacacccagctgtgtttttgtatttttagtaaagatggagtttcagcatgttgcctaagttggtcttgaactcctgagctcaagcaatccacctgccttggcctcctagagtgctgggattataaacaagagccaccgcacctggcctgcacaaaccctttaagagcataaaagcagggcacgtttgtataaatacaaagcaagtctttttccctgaagagtcctcctgccttgattaatgttcccaaagagagggggagctgcatgttggcaaagttcccaatagaaacctaatcagtgattccagcaacctttttggagtgttttattggctaccccaggtcctacctcatatttaggctccttagtctcagcatcggctccagcattgctcttagttttcagctctttcacagaaatgtgggccttgaaactcttctgcttctgctttgccatagttatccaaaccggctctgagacagcataatctgactgttgaccagcaggctttcctgagaaagaaatgaaaggagttagaactgaagcaaggcaggcagggtcttgagcctggttggggcttacccacaataatatcccaaatgggacccttgttaattgccaaaggaaaataaacagatatcaaacagagaaggccccccttttttgggccctccctatagcttggcaaggcaggagttccttgggtagtaaagaagctgtacttaaaagtgggcccttcccttgtccatccctggtgccatctgcaaatcagagtaggacaacgcttgccaggtgggctgggaaaatcccaaggatgccagaggctcaggccattgatgccattcctctaactcctagaaaaatctttgaaaaatctttgaaaaatcctagaaaagtatttgttacttcatagtccctcacacaagtgtgtggttacataagtgtggttacaggaatataaaagatttttccaaggatggagtgtgaaggtccaaaggttttgggagacattcgtgcccaaaagatcgcctagctctaaattcttagatatttcagatgagcgaagagacatttatggcaaattaagatttcaggctgagagactgaacatagtgctctacgaatgagttggctttaaaaatccacatggtgttagggaggggcttaatacatgtaaaagtattttgagaaaagcataaaattccatccaaatgtaaggtgtgcagagggtgaggaagagggaatggggaaatggtcatgtgtctactatggaatgtagatggatgtccagagggggatcccattaggaaagggaaggctcaaaattaactacctccaaatctattaaatctagaatggggcactattttgctcccaaactcataaaccagccctatcaaagccacaattcagtaaaagactagaatagactttaatgcccattcaaggctttgctttccagttgtttccacttgatatctgcttgccatctggagagataaaagccttacctggggtcttgcaagcaggttgcttcttggccatgctttcagatttgggcctgctctgttgcttatctgcaacgtaagatattttggtgaggttccctgcagcatccaggagcccctgggaagtgcttctgattttatgtcccctgcctacagaggatgaaattgggcccgagggcactgaagcaagctgggtgaagttatcttgtttctcactcttatacttctgcgagggaggggctcttttcagtcgaactccaaaaagcttttcaacatcatcctgattggataggtttgcatgctggttattattaccatcaccactctcaagatcttctttcttagagtaaatgcccccagaagtggatgtttgcctgacaggagcaatggtgaacttcccaggtttggtagcaggggctggaatgctctttatggggtttttggaaccttggctgaatttcttggttttgattgcaaaagcttcatctcttcctaggaaccaattgtcagaattgctctcaaaaacagatcgcctagcagcagcattcacagaacttgaatgaacctgttgctggaaaggactacttgaaggcaggtgcttctcaccgctgctctgctttacaggtacattcactgggccctttgatgacatctgtggctggaatttagacctatctgaggcttgggaagaatgtttgggaggcagctgctttttagaattcctccactctttaggagaactggcagaaacaggggagactttttgctcatactcaggtttcctcaaggcctgggaaagctgcctgggagacagctgctctttaaaactgctgcacttcccaggagctctctctgaataagagaaaactttctgtgggtcttcaggcctccccaaggactgtaaagggtgcttcataggtagcatctttgaagaaatgcctcccttaggattagcactccctgaatctgagaaaacttggtgcttgacttcaggctttgataaagatttggaaggaagattgggaggcagaggtgccacatcactgcccctcttaagagcagagctctctgaaaagatttgctgtgccataaatttcacgaatgactgggtcggacgcctgggaatcggtgatttgttagaagtgccttcaacagccattttctctagtcgtgaggtcatttcctgaactttagacctctttaagaactgggtagcatattggggaggcaatggactcccagaaatgtctgcctcaatagcagcccgctcgaaatttgaggacagttgctggactttatttcccacagtcaactgggaaagatgtctgggaagcagctgctccttagaaatgtcctcttcaacagtagtgctttctggatgtgcagagagttgatacagttcctcaaatttaggggtcacccatggcggggaagtgtatttggaaggtgttggtgccacaggactgctccattctgcagaagtactcattgagtccaggaacttaggcctctccgagggctgggaaaggcatctgggaggcagcggttccacataagtgccttcctcaacagctgtgctttctgagatttgccggatttgaggatctgtcaaggactgaggagaatatctggggagtagtggctccacagaaatgactctctcaacagcaatgtcctctgaacctgagaacatgttttgttgaactttaggattcatcaagggctggcaaagaagtttaggaggcagaggcttcatagaaatgctctcttcaacagccatgctctttggagatgaggaaacttcttgctccactttagggttcacccatggctggaaagggtgtcttggagggattggctccacggaatcgctctgttttatagaagtgcccactgaactggtggggacttgttgctgaacagtaggattcataatgggctgagaagggcatctggaaggcagctgctgcataaaatcattctgctcttcaggagtattatttgaagcagaggagacttcttgttggtttttgggctttcccaaggcctgagcagggtgtctgagaggcaggtcttcctctgagctgctgcaatcatcagaagtgttgtacttttcaacataactgcttgattctgtgaagacttctgcatcttcaggctcctctaaagcctgggagaggcatctgaggtccagctcctcctcagagctgctcaagtcctcaacaaaactttttgattctgagaagacttcttgttcatcttcaaacttccccaaggactgggaagagtgaccatgagccagttcttcagaaccatccccctcctcaggaatattctctgaatctgaggagacttcttcagcatcaggcttccttgaggactgaaaaaggcttctgggaggcagagtcttggcataaacatctcctttggctgtagtacttgtcatacccaaaacacttgctgtaaaggtctggtgaacatttccagaaggcttttctttgcagatagtttgaacatcctgggctgactccattttggattgggccttttgtaaatcaaagctgaaagcttcttgatcttctaactggatatgagaaggattcataaacacctgagcctctgctgctactgagagaatggcctcctcttgggttgtagaaaggctttccaccatcagtgagagagaagctctggcttctgtcttctcagctccagaagctgcatcttcatggtatggttgtggatcactaaccatggaattgtccatgttttcaggtatgggctgtgctgctgatgcttttctggatccgaaatctatgccagcatttctccttcccatgtcatctttatctgaaagcaacccctgaggggtagtggtttctggttgtgaagttgtaggctgctccatgttgtccttctctaaggacaagtgcgagaaagggacattcctggcagtcttattggtaggtgaagacccagctctatcgcccaggccatacccttcactggattgtttaaggcttcttcctttgaattcacacccactcaatcctgaaacacttgctccttttcttctccatcttcttccatatgctgctgacattggatagccctgactccgagaagcatcagtgtttggagcctggtctgttgtcttcttatcatacatctcagttttgttgttctgtttctggcttgaggaatctgcaccaaacagaaataaggaaaggagaaatatgtgtgactttcacttcctaaaataagaatactgtgccctggcccagtggtacctatttgctactaaatttcctagtatgaggaagcagctatttggaagacagagggcaacatggtcactattaggtttctgcagttggatatttttaagccaaagagaaatcctagttctagaaactgactccagggttggcttatcacctttttaccaatagtctggtccaccattcagtgtgagacacatcagaaggcaaattttgaacctgtaacaatgactacctgtggggaaactgactggggaaggaggaattgaattttttactttctaattagcatttctattttctacataatatttatctgaactacctgaaatttcatatcatgtgcatgtattgctttttttttttttttgagacagaatctcgttctgtcgcccaggctggagtgaaattgaaaattaaattgaaaattaattatggttctattttacactctacccaaagacaaatttcacactttgaattcatacatcataccaggctgcagtggcgcgatctcggctcactgcaacctctgactcctgggttcaagcaattctcctgcctcagcctcctgagtagctgggattacagacacatgccaccacgtccagataacttttgtatttttagtagagacggggtt[133 bp omitted]aataggagttatctgggaggcaagattatggcccccttttcttctttttttctaccctcttacattaaaacaatcctagttgtttttatttccaagatgcagattggaggcattgttagcatgtctctcccacttggaaagacaaatagcatgtagatattcatgctgtgagctttttccaagaagcaacacaggaacttaacagaaagagtgaaagaaaccacagaccctttgaaagaagtgatgggcagcagcctacactgtgaaccagatggaaaactccccataggagacagtgaacctgcgcacacacccagcacatcactactacagtcagcatctgagaaagccatcacacaaagatactctgcaaccaaggaactcatacagagtcttcaaaactgaaagcacccagagctgaagccaggtgacaataaactataataatccattaaaaagtgggcaaaggatatgaataaacaattctcaaaagaagatatacaaatggacaacaaacatatgaaaaatgctcaatgtcactaatcacgagggaaatgcaaattgaaacacaacgcgatatcatcttacctcagccagaatggccattattacaaagtcaaaaaacaatagatgttgggatgaatgtgataaaaagagcatacttatacaccgctgctgggaatgtaaattagtgcaacctctgtggaaaacagtatggaaatttcccaaagaactaaaaatagatctatgattcaatccagcaatcccactactgagtatctacccaaaggaaaagaagtcattatatcaaaaagacacctgcacacatatgtttattgaagcacaattcacaattgcaaggatatggaatcaacctaagtgcccatcaacctatgagtagataaagaaaatgtcaagcacatgctagtagttgtacagattactcctctcctttcttctagtacttttctaaggaactcactttgatccccagatggaagggtccctcgctgcctttcttccctcactatctgctgcatccctagctccatctaggggtttcatacccagcatacggcgctgagaatagctgactgtgctccaaaccactttcatgatatggaaaatcaactaaagaaaatgtgatactactcaggcataacaaagaatgaaataatgtcttttgtagcaacctggatgaaactggaggccaatattctaagtgaagtaacccaggaatcgaaaaccaaataccacatgttctcccttataaatgggagctaagctatgggtatgcaaaggcatacagagtggtatattagacactgaagactcagaaagtgggaagggtaggagggggtgaggaatgaaaaactacataatgggtacaatgtacattactctaatgacaggtgcactaaaatcctagacttcaccactatacaatccatctgtgtaaccaaaaaccacttgtacccctaaagctattgaaataaaaacatttttttaaaccgatcatatgtaatacacatgcaaagaaattcttggaatgccttaagaattgcattggtccacaggcttcaggtcaagcacaaggtagtagttgtacagattactcctctcctttcttctagttctaaggaactcactttgatccccagatggaagggccccttgtgcctttcttccctcactatctgctgcatccttagctccatccagtagtttcatatccagcatacagcgctgataatagctgactatgctccaaaccacttccatgatatggaaaatcaactaaagtatctgccaccatggatactgactcagttctatcctctgtgtgtaaaagagacaactattaaaaaataaagctcaaaggctgggtgcagtggctcacgcctgcaatcccagcactttgggaggccaaggtgggcagatcacaaggtcaggagattgagatcatcctggctaacacggtgaaactccctctctactaaaaatacaaaaaattagccaagcgtggcggcgggcgcctgtagtcccagctactagggaggctgaggcaggagaattgcttgaactagggaggtggaggttgcagtgagccgagatcatgccactgcactccagcctgggtgacagagtgagactccgtcttaaataaataaataaataaataaataaataaataaataaataaaaataaagctcaaaaagacaaaagagtactcatttaatcttcctttttctttttttttctggagggttttgtggttttcttagtattcatgggaaaacgtgtttaggaatgtcctgtctttggacccacatgtgaaatcctttgtggcaaaaacgtaacataactattcaacttaatttgaggaactggaatttttttatcaaatactgctagaaatcagcttgccatcaactggagccaacatccacatatgcacccacataaacacacagagagattttcactctggtgatatttgttgtttggggatttgataggtgttggctgccaaggacatctgtctgcagctgcataaaccctctttgtccaaggatgtgggcaatagtatcattattaacacagacattttctctctacaggaagagaaaggcaactttaaaaaaatgattttttggccaattctattattcctttctggttctgctgctgaggaagaatgctgaaggggaaatcagtggttgtcctctcatatctgggctcactgaggaactcagcatgtacgttagcctcggagaggatgaaacaaattcacaaacaaaacacctctcttgttggaaattcatttacataaaataagaatccaggtatgatcctttacctgaaccccacacaagtggcaattgtattactttggcagtttagatggagaagcctggacaacattttctgcatataaaattgaaagctctctgaagaccaagggcagcagtcttgggtagttcttgggtatagctcctatcaacatagcactgtgcaatgaagtctgtcatacatgtttctgggtgagggtgaagatatgctaacctgcactgtccattcccagcttcttttcgttgatttcttttggtttggttatgctcttttcttcttcagaaaccaatggaaggtttggctcctcctcctttggttccacctgaaacaggaaaagaaagagcttgaatcctactgaagtgctttccaaccacgcctgcatggttgccaaagaaaaagcatcaggaaaaaagttcttgatgctgggcacgtaacagtacctttaaagatggacgttatttcaatggagatatttccagggatttcttaatggaattgtttccaccaagagatccttggggatcattttacctactggaagtggttcatccaggtttggagtttctaatgtctgagtgacacactgcagggatccctctaaaataccctggaaatgactgaaccacactggaaggccacgaatctgaaaacggggtcattgggcctgacaacaatcatgccctcggccatattgggattctccgatttgcttcaccagacctgtgagtcaaattcaaatcctttttggcttcttttcagggaatgtaatgaaagcatgaattatctctttccagatcaaaagaagaaaaagaattggggttttgttgggagggaaaggagaaaaagctgaaaggttcagcccttacactggatgggctgaagttggtttagtataaataaggttttctgataattacaatacagctctggaaatgtcagcatagcactgcactgaacagtgtccggaatttgcttagtgtaagcctttatggcatgcatgtaaagacaaacatgtaactctttacactcccactcaaagtgcctgtgcaaacagacacagctcataataatttatttttgagtaaacgtggtcagattggcctggattcaaaatctcttcatcatttacttgctgcgtgaccttgggcaagttattctctgaatcactgtgtctacatcaataaataagggaccaggagaaacctcctgtgggacttgtagatctaagaaattacagagcagggagaaagtggtagtagtccctgtgtcataaatgatcctggatcttttttatgttcatccacatgtcagagagagagtcacagggaagaagtggatgctctggccttctcagagggtaatgcccgggctttttctcaactaggctatacagaaagaagaaagttagaagggtcatactgcttccctcagccaaccttctccatctcccaggtttgtggtgaggtattcaggggataatgcatgtatagggtttggcacctagtaattggtcaccccttctttgacaccaaactaacaaggtactctcaaggccaccagagggcttccctctgccgccctgctcctccacctgttctttcaactcgtattttgtctaaaacctaaagtgaaattgagatgcctaagctagaggcaagatggtgggatgaaaaaagtgttgagctggaagtcagaagactggattctggccctagctctgctatcacctgggtgtttgactttgggtaagtatctgaaattatttgtgctttaatgcccttctctgtaaaatgtttgtactatacaatcttttagtcacttcacctctgatttacagtctcttcctttcagcccagaatcactggcgaattcagtttttgatcaaagtgagttttatagacaactgacacatcgttttaaacactaaacactaacattttttaactttttttttttaaacggagttttgctcttgtccaggctatagtgcaatgacacaatctcggctcaccacaacctccacctcccgggttcaagcaattctcctgcctcagcctccagagtagctgggattacagggatgtgctaccacacctggttaattttgtatttttagtagagacggggtttctgcatgttggtcaggctggtctcacactcctgacctcaggtgatccgcccgccttggcctcccaaagtgctgggattacaggcatgaaccattgcacccagccctaatccttaacttttactaaaagccttttccaaaagcattatttctctatctttttaaacagggatcacggaaaataatctactttttctagatgacttggacaaataataaaattatctattacattggactatgatatagtgtggccctgaaggacatattgaggtgggcaaggttcttgagcccctatattaaatggccccagattgtttctgtcattctgtctgctaccagctgtcacttctctttgctgtcaggtctgagtctaatctgtggccatgtttttaacacagtaggtctgcttcctggaaagtcatgtggcatctatttggagatctttggatgggttaacaactaagttctggatgtttagggttgctgaaagcttgatctccaaataagtggaatagtgctgcaatttgtgactcatgggtctcatctgattaataactgaaagaatcctgatctgggctagggttgaatattctctacaaatagggctgagtgaactcccagatgttagcccaataagcagtttatgggggtttaaatcatttactgtttctgcttccttttagtcccttctaatataagttccacatggataggaaaccacacccagcagatgcaagcttgctcacccctctgggggtgtcaagcttaggacagcacccttgaccttgccaagcttacttagggcatgagtctcctacaccatactatttccctagtagtagtttgcaaaggttggaactcatcttttcttatacaggagtttagtgccctgtctcttgaaggacttacaatcacttgaaggttcttcttttgtttgcggggatttaaagtcattttgtggcgagcagctgaagaatccaaacagccctgggtggtggctggggtgctgaaaccaatgggcagctgggtgctactggtagaggcaagtgtggcaaatgcagtcaaggactgtgagcaatcaggtccagatgataactcagagaagctctggggaaggtgggagaaaatagacgagtcaacccgtatgctgttactggtctcaaaagttggatattcttccggctgaagaattcccaaagaagaaatccttcatgaactattgtcccctttcctacatttcctgtcaatgggcttattcattagaggtaagctccataattttactggttttcttgcagatgaaaacaagaaacaggaagaagtttgggttactcctctgcttagaaagctttcaggggcaccccattgtccttgggatgggaacacaaccacttaattgagtttgcaaagtcagagagattgcatgttctcttgtcctagatccccttcttatcaacaggacatctggctggggtgagaggaacaattggtatcagtgaaacccagcagagctctgggatttctatattggagggttgggtggagggaggaaaatcaggttggaagagggcctgtctgcaaggtgcattttcatagacagcacactaccttttatttatattgacagttcatgggtgcaagactgatgggaggaccctcaggaactgaatgctctaacctccagtgggatagtgatggagcctgtaaccctgtcctcattatggctggcctccatatctccatactatttggttctgggacacctagttgaattcctctgtaggatcttcaaaatagtctcctctgggcttctggacatagcattttccatatctcaaagagcctccccagagctctttccatttctaagaagatttcgatttctgttagcagaaggccctttgaagatcagctgataaactgtctctgctagatactagtagcaaaccatatattataatttagcaagtagacagaatctcccattgtgtttacccactaagttctcttcaggctagttttgcaaagtgccaggtatccccttggtacttgcagctttcacatgccttcatggttcccaccaccattgtatgttgatgcagtgataaccttagctactatcttggttatgaagatggcactgtcattccagtgcatggggacttaacgcagtgctaatgagtcaggctgatgacaaatcctgcagaccattcagttttggattcagggagaagacagagaaatagtacagttgacttttgtgggatcaatcacacaaaagtaggattgatcccaagatttcctttacttctttgtgcaactttcatctatgaatttatatactgcctcttcctgatatcatctagttagattatgttatctactggaaatataaatttgatatcagtgtatagactaaaagctcttcttttattgttctgaacatctttcatacctcagagtggtgtcatagttctggtcttttggggctggaggataacatctatgctcccactaacctcacatgatctgtcttccttttatccctgaccacattaccagccatttcctgctccagacacactgctggtctgctgttcttcaagcacttcaggcatgctctccccttggggccattgtgcctgctgttccctctgctaggcatgctcttcccccatgtccatgtggctagctcccctacttttttcaggttttgattcaaaagccaccttttcatggcctggtgtggtgggctcacgcctgtaatctcagcactttgggaggctgaggtacgcagatcaactgaggtcaggagtttgaggccagcttggccaacatgatgaaactctgtctctacaaaaaatacaaaacttagccgggtgtggtggcagatgcctgtaatcccagctacttgggaggctgaggcaggagaatcacttcaacctgggaggcggaggtttcagtgagctgagatcaccccactgcactccagcctgggcgacaaagcgagagactccgtcaaaaaaaaaaaaaaaaaaaaaaggcaccttttcagtgatgtcttccctggccaatctatttaaaatgtttgagccacttcatatccccttccttacattgtttttctccctgtcactgttctcactgtctgacatacaatatgttttccttatttagcttgcttattgtccatgtcccccattacaatataaactccatgaagaagggtttttatctgttctatgtactactgtattggggatacagtacctccaactgtgcttgtagtagttgcacaagcactacatggtagttgctcaaaacatgttttttgaactggtgacttgattacgttaaaggcttccaccagaagttgcctttctgagatgtcatcagagcaagctcctctgttctctgtattattttagttattctttctgaggcctcactagctccagccaaaggtaaaaggagaaaaacaaggaggtctatgaatctggaaaccctaaaagaacaccgtacaacttgctttgcatgaaagccaacttatgatgcccacatggcaagtaagtacatatttaataaatataaagaactttcaattcagttggcatcccaaaccttgtggtataaacactaaagatacttaatttactttagtgaaactcattctatagcataacagaaaaatcaggctcagcaaaaatctggcaatttctagattgggtatgtgcaggacagagtttatctgtttccaatcacagccgaagccaagagtccatcaaacttaataacagccactgatctccctgtgttagcttgactctcactaaggaatctatagacatcagtctaaacacagacccacatccattctcaaaccggggctaaaaattaaagagcaaaacgatcaagcattctcctcatctgactatggagctcaagctcagacatgtgatttaaaacagtcttaacaggatctctgttgttaggtttagagtatgttatgtgggtatagattatatgtatatgttatgacttcccttaactcaccagtgaattaaataaactatacactctctggaactctacacagtatttctcaatgtatggtctggaatcccccagcaccaaaatcacctggaatgagtgttgaaaaagcacatttcggggacatatcaagacctaatgagtaagaagatcaggggaaaggctttagaatagctttaacagggtttccaaatgagtcttccaggagccaaagttgagaaccaatgcctagtcctctagcatgaagagaacggctcccattttcaaatatgagtacagcaagttcaggaataatcccatcagttgccttagaacaggagtcagaaatatatggattccttttgggaagtgtggctccttcttaggccttcttaggtcctctttccctcagtcctattggttagcagcaacttagaagagttaccacaggccaggcatggcggctcacacctgtaatcctagcagatcgcgaggtcaggagatcgagaccatcatggctaacatggtgaaaccccgtctctactaaaaacacacacacaaaaaaaaatagccgggcatggtggtgcacacctgtagtcccagctactcgggggactgaggcaggagagttgcttgaacccgggaggtggaggttgcagtgagccgaaattgtgccaccgcactccagcctgggcaacagagcaagactgtctttaaaaaaaaaaaaaaaaaaaaaaaaagctaccacagaagccaaccacaggattttatgagttgcccaagaaaagcaaatagaatcccttcctggcagaattctgaaagaaaaacgagtggagaaagtgggacacctttctctacttttccatcctcactcccctccaaccctacttctccttccacgcactctgacagccaacataccctgtctgaacccaatctgcatattattttttcgttcgtataaatctaaggggtagaagcgtagcttattacatggatatattggatatatcacatagaggtgaagtctgagcttttatttttactgtaaccatcacccaaataatataccttgtacccattaagtaatttgtcatccctcaccctcctccctcactcccactcttccaaatctccaatgtttatttcccacactctatgtccaccgtgtacacattatttagctcccacttataaaggagaacatttggtccattatgtatattattaagtacagctgagatgttttcatttcttctcctgtgttttagagagagtttagcacagatatcttcagattaatatctggaattaaatgggctccttgtgcctcaacatctgggagatgtgcccggcctggtacctactaatccagaatcttcttagagaaggaacctgggttggaccttgggccaggggaaaggattcttcagcactggttagtagagagctggacactcttttgctgttagctgggataagggctgctctttggaaaataataacacattttcacttcttttttcccttctgtcaagtttctagacccagtgcaaaggagtttagtcaataatgcacattttggtagtcctttttaatgatttctttttctgttgtatgatgctagggttttccccttttgagcagggatagagagaaggttgactgtcttcctggaacaaaggaaagctctgattgtaatgtcttaaataaggggattaccaggtggctgtctaggcccagatttcatcaagcatttggcccataaagctgtcactcttgagaaaaaatacattctgaaactgacactgggatgttggagagttgggttctatgtgagtcaaaagctaaaagcatgtgtctatctccacaagaagaagcgactcttggtgggaaatgtggttcttggtgggagacttctgcaccaagaggtactggcacagagtgtgagacccaataatggctgtagggattttaattctctgggtgtggcaaagtggcttctgtgcccattcctgagagttcctgcacagctgctgcttcattcaaaatctatgttacttaaaagctgttgtggtcaatatttttgccaacttgaaagttcttagagatggaatttctggtattccctgcagcccccttctatcacaatctcttcaatttcttaactagtatagagaataagaacatggactttgaaaccaaataggcctgaatatgacatcctagctataccacttattggctgtctgaccttgagcaagttccctagcccttttgagcctcagttttcatgtctgtaaaatgggaataatcataatacatactttggtttgttgttgtaaagattaaataaaattatacaaggaaagtgtttaacacagtgcccgttacataagaaagtcttgataaatgttagctgtcgttgctattgctgggcattggttataaaaagaggactgctagaagccacatagttcagtgaaaagtgctatggatttggtcaggagtcctgggatcaagccccagctctatctttgattggctctgtggccttggccaagtcacttcacctctctgaacctcaattttttttgatctttaatgagaatctttcctatctgctttacagagttattgagagaatcaaatgtaactatataaggaaaatcactttgaaagttgtaaatttgtatacaatcatgggagggagcattatgttctcctttgatgtattagcggattttaaaactaaaattttatttcattttagagacagagtctcactacattgcccaggtggaagtacagtggctacacacaggcatgatcatagtgcactacagcctggagttcctaacctcaagtgatcctcctgcctcagcctcccgagtatctgggactacaggcatatgcagcagaagattgctttaaaaaaaaaaaagatggctctgggcttcggagacttatttgtatacaatgctggggaattatggtgtaagccatccaggtaaagcatgagatattataaaaagaggcatacttgtagcactcaaaattaactctttattagccaattcagtggaataacttaacccccaaatgttaaatgccagcatttatcctgcaatgtgactgaggccagggaatttaatcagcccaaactttaagctttaagaattttaccctgacaatgtatattgatagcttatcttcacaggtgtgggacaaaggacaaaactcaaactcatccgtctgctcacctgagacaaatgcatatttgattgcttcttctgatgtaaaaatgcagattcactgaggaagatgaaggcataagtgactattcctctaccccctctcacatgtaaattgtgtattcagtgaaaggctgatcaaagactcaaaaaaatgcaaccatttgtctcttatcttcccacaccttttaaaaatgtggtcatctttccccaatatccgccttttccccctttagacattgaagccctcaaaattatctttggagaaaggcacagacctgcctcccaggtgcacatccttaaccatggcaaaataaaatttcgaaattgtttctgacctgtcttaggtacttttctggtttacaaactcaacaacaaaaagataaataacccaattaacaaatgggcaaaggagaaatagatatttctccaaagaagatacacaaatggctaacaagcacatgaaaagatacttaacatcattatttactagagaaatgcaaatcaaaaccacaatgagatactatttcacacccactagcatgactataatttttttaaaacaggaacctaacaagtgttagccaggatgtggagagattggaaccctcatacattgctagtggggatgtaatgtaaagtggtattgctgttggggaaaacagtttggtagttcctcaaaaacttaaacatagagttaccatatgacccagcaattccactcctaggtatatacccaaaagaattgaaaacaggtgttcaaacaaaaatttgtacaagaatgttcataatagcactatacacaataaccaaaaggtagataggacacaagtgtctatcaatggatgaatggctaaacaaaatgtggtacatccatataatgaagtattatttagtcataaatagaaatgaagtactgataaatgtcacgacatggatgaacctcaaacacattatgctaagtgaaagaagccagcacaaaagccacatattgtatgattccatttacgtgaaatatccagagtaggcaagtacagagatagaaagcagaatagttgttgtcaggggctgatgggagatacgaatggtgaatgactgcttaataggaacggggtttccattttggagaaccaaacaggttctggaccttgatagtggtgatgattgtacaacattgtgaatgtatgtactgtcactgaattgtatactttaaaatggttaaaatggtaaattttatgtgatctgtattttactacaataaaaaatgttatctaattcaatccttccactagttcagattatacatcccaattcatctgatttagtggcattctgcagaaaatacttgtagtcatagcccagatccataaaacaataagcatccatccacctactaccagtctgtgctttaactttggttttaacctaatttctttgttgacatatctaactgagggctgcttcacttcataggatcttttaacatcaaaatagagttttgttctgactggccaattctcttccctataaattaggtttctgtttactttttatttccaaaggttaatcattctaaactctacctcactctcagagccttttcaagttcaccaacaaccaattcaattaaacacacattagtttgagaatggaagtgttgatatgagcacacactattatacgctgattgatattatctggttgacaaacctagacatatgaaatagacacatcgccctctcacgtgtcaactgatttttcacatggatatgtgtctatcaaataatactatatgtcctaacctctgatttttttggatttctaagtgtagagtctatgcttcagtaaaagtctgtatttttatcttcatgaaataactcaaaacatctgcaaactattattttttcgaaaatactatcttcccttgcttatacattaaaatggtgattatttggtttgtagaattggatggaaaaccaccatgcaaatcaaaagccaagaatgtcaggtccttccccaatcatccccctagtgttgagctccagcgggagaatagatgatacaagaagaagttatgcctctgatctgtgaggcccctcaacctgtcccttaatatatactcacctgagtcgctgtcaaactcttatgtggtaaagccttcttttgtggattcttaggtgactcatcatcgagagagatttctaccaagttcttagaaattatttcaggttggataacaggtgggatgatgctgagtcggcgtcggcgcgatggtgggttctgtcaagagggagaatagaaggaacaatttaaaacctgtgctctcttcctcaaattagtggttttctcttattctttaataagagtaaggaatccaaagttggttgaaggactaagaatccaaagtgaaaaaaataagcccagggaagaatttcctacctccccgtcttcattcctagtacctactcaaaccaaagactactagccttgatttcccctctggggtgctgcacacttttgccaatccccaaacaaagacagaaacttcaaattgcttgttcgtgcaagatcagaatcctgatgttatctccttactgatgttaaatacaaatctcatttagttctgatctttgttttaatgtctgaatttgactttggaagtccagttctcatagaggcgagtcttttgagttatgacctggaattggcatccaaactgcactctttgctcctattattcaaggaattatttggattgaatcttgactgtgttagttgcttatcttaatcatgtcaataatgattttctgggattttaaagaaaatctacagaatttaaaaatctatagattttaaagaaaatctatggaatggtttcctaaagggacaaaaatttatcatttgggctttccttgggattcagcagacaatttagttgattccattttgaagaaaatggtacacttgactttgagacactggtccctgccatggtcctcttgatgtgggtcagaatccctgctttttatctttaacaaatactggccaagaatctgcaatgcattacaccccattccaggaaatgggcctacaacaataaacaaaacaaattcttgtggtcatgaagctgacatacttgcttctgttgtagactctgctcagctcagggcagatagccttcagacactgtagccaaagaaggaaccacagtgaagcttacaaaggttgtgctcctggggtgctcctggccagtgtctccagtgcttccttattactaccaggccccattgggagctcttggggagaggccatatcaaccaattccaagcccagctttaataataataattacaataatgacaactaacttttactaagagcttacaatgtgctaagcagagagtgctctccatagatacatctcactgaagcctcacaacaattctttgaagcatttgctattgtgggctccattttacggacggggaaaacaaaatttgagagatgatgtaacctgccctaattctttcagtggcagagcaagcatttgaaaggtctgtccagcttgatagcccttgttcttgatcactgtgaactcgtgtctcctaattataagagccagaaaagggagagcccatactgaagcccaagttcaagacgtttaaaggcaacaaccagaacatatggtgtgcctgcttccttaagaagggctgagggacagtcaagcccgtgagcagtaagaaaaactgttttgaagtctcagtttcttaaatgactaaattcaatttgattcaacaacagcaagatgctaataatctgccattgtatctttttaactatttgtgctcaaataaagggaacagaaaatgtcttggagagtaatgtaggcatccacattcctaacacttcagataggacattaggtgaaaatctggcaggaaataaaattggctcagtgtcagtatttctgacataactgtatacctggatttcttctttaacaatctcctcgttgttctgaatgtcacttaatccattagaatcctgccccttcaagggaattgaccccactggccaatttcatgcttgccccagcttttatgtagcactgggtgtcaggacccttgacttaatgctatcaaccatccttccattggggttgtcattttggtacttaagggaaatttcccatgcaaaggtcaggttggttgttgataacttaggtcctattaataccctatgttgtcttcagccttgttttccagggtatcaactaagggatcaggccaaaagtgtgaggtataggcccaagccaaacatttaagaaagcttgcctttaggctattgtggccttccccaaccacttccttgtgagaagtaatgcccctagaatattttcctttaattttcacaaaaaataatttttttaaaaaaatggaatatctctgctatatgagtctctctgttgctgggacttagagaggaggggaaagaaggaggagtccaagaaaccagtttcctctttctgaatgtgagaaccctgttgccacttggtcatggtcatgaggctgcagggagtgtaactatggaggtgagtgaaagctagtgttgatgtttaaaactgaagattgaatacttcatggaagtgacttttcctgctgtagtacaagagggaaatagtcttctgaccctaggggctgcttaacaactttagggtcaacaccattagtgtctatctcagtgttttctcctctatagctaaaggatccagaagaaaggaaaccagagtgagagatgtggggtcttaacagacatgtcagaaataagccccacttaccttttgccaaatggaaaataatcatctctccaatggagaagggtctcctccttgttctcttcccacttacacagggacctttgggcataattccacccacaggctgagacggggaaggcagctgttaagggttgtctccttgacaatatcttcagctccccctgaagcatttctggatcagagctatactctgactgagcaatggatccctaccataagtttaggattagctggaggcaagatgctacatacatgctacattatgtaggtgctaaggtgtacccttctttctgtccaggcaggtataaagaagttgagcatcttggggtaatggaaagatcatggggtttgagtttaatacacctgggtcagatttccaagtctacaatttactaccagggtgggcttgagcaatatctttaacttctctgagtcttcattcaatcctcacaagcaaccctttgaggtagatgttaatattatacccactgtagatgaggaaaagaaggcccagagaagttaatcaactagcccaggggtcacacagccagtaagtagcagagtaggaattcaagcatagatctgtctttctgactcagctgcccatgcgctgaacaattccactttgttacctcagtgatcttggggccagcaacccagactgcacttgtaggcacattttgaagcacagctcctgacatggctccagacacaactccaggaaccttactcctaggtttaggcagagttctggaaatatgggatctctgtgtaagagagagagaaaaaaacttgaggattggtatgccagcacataaacagtggaatgttgctgccaaaataattattcttatggtgtgttaagagaagtgaatataggccaggcacggtggctcgcgcatgtaatcccagcactttgagaggccaaggcgggagggttgcttgggcccaggagtttgagaccagcctgggcaacatggtgaaaccctgtctccacaaaaagtaccaaaaaatcatccaggcgttacaggcctgtagtgccagctactcgggaagctgagcctgggaagttgagtctgcagtgagccatgatcatgccactgcactccagcctaggtgacagagtgagacctgtctcaaaaaaaaaaaaaaagaagtgaatatggcaatactaatcaacactgtgtgccaggtaataggcacattatatatttatacattctgtcactcaaggcttacaacagccctgtgggggtaggatcagctgagaagcagaaccaagttcccactccttttaattttggcagggttagagtagggaacagaagagaagtagtccaattagacactgatgctcgagtccactattacctgctgaggtctgcctctctggggatccatagaaggaaacattttacttgctgatctttcaggctcaggacccaacatgaagatgctatcatgggatagggctttgctccccatgctgctcttggccctggacagaaaggaaaggtcttgtaaaagcaacccaagggccatgggaactgaagacaaatgtatattcataatatggcctaccatagatacctcagaaggagagcagggatgcatatgtgctgacatagaaagtggttcatgagatagtaagtgaaaaagataatagtatggtcccatttaatatatacacacatatatagttcatattcaaagaaaaaagtctagaaggatatccacaaattgttagaggtggttccctctgaggaatggcgcactagggacaggaatgaaattttcattttctacttcatgtccttctgtataattttaatttttacattatgagcatatatcctttttacataacagtcttactgagatatagtttacatgccatacattttgcccatttaaagtatataattcaatagtggcaattccggggaatgggaggaaaggccatgagttttgttattattacagtgagaattataaaagatctttcacatccaaatttctctcgtgtttttgttttgatttaaaaaaaatcaaagatcttcacagatacacaaggctttaattcatcagatcctttcctctttcacacaagagctctacaatatatctatcctattttcaaagtcatcctatgtaccacctgcacctcccttccccaagcttgctaaatccagatgaaaataccttctgattgggaatggtgccaggttgatgataattacatgttaagaaaaatcagaagaaagataaaaacaaatgaaaggctaaagacatgaaagactcctttttggagtgtggtaatgtattttacctttaaaaaatttcaaccaaagacatcacaggaagagcaaactacagaccaatatctcttatgaatatagacacaaaaatcctcaataacacactcacgaactgaatccaacagcatataaaaagaattgtataccatgacaaagtaggatttacaaggaatgattggcttaatgtatgaaaatcagtgaatgccaaacactgtatcaatagaataaaaacaaaaactatatgaccatttcaatagatgcagaaaaaacatttgtaaaattcaacacccttccatgataaatgcactcaatcttgatagaagatatctgtgacaaaccacggctaacatcatggtgaaggctggatatattccccctaagatcaggaacaagacaaggatgactgcttttatcatttctattcgacactgtatgggagattatagaccgggaaattaggtaagaaaatgaaattaatgccatccagaatggaaaggaagaagtgaaattatctctattcacagatgacataattttgtgtataaaactcttaatgaatacgctaaaaatgactagaatatatgaattcatcaaagttgaaggatgcaagtgtatttctatacacttgcaatgaacaatctgaaaatgaaattaagaaaacacttccctttacaatagcaacaaaagaataaaaacttaaaagtcaatttaacaaaagatgcgcaaaactcataatctgaaaactataagacactgatgagaaaaaatgccaaagtcctgaataaatgaaaggaaatcccatgttcattcattggaagacttaaacttgttaagatggcagtacttcacaaaatgatctacagattcaatgcaatagctattgaatttcatgctggctttttttttttttccagaaaattgatcttaaaattcatagtgaaatgcaagggaccacaaatagccaaaataatcttgaacaagaagaacaaagttggataacttatacttcaatttcaaagcttactataaaactacagtaatcaagacagtgtagcactagcataaagatagacatatagatcaatgaaatagagttgagagttcagaaatgaacctatacatctatggttgattttcagcaagggtgccaagactattcaatgaaaaaagaatagtctcttcaacatatggtgctggagcaactgggtatccacatgcaaaagaattaagttggacctttatctcacaacatatataaaaatactataaagacacatgcacatgtatgtttattgcagcactattcacaatagcaaagacttggaaccaacccaagtgcctatcagtgatagactggataaagaaaatgtggcacatatacaccatggaatactatgcagccataaaaaatgatgagctcatgccctttgcagggacatggatgaagctggaaaccatcattctcagcaaactaacacaggaatagaaaaccaaacaccgcatgttgtcactcataagtgggagctgaacaatgagaacacatcgacatggggggtggtacatcacacactggggcctgttgtggggtggggggctaggggagggatagcattaggagaaatacctaatgtagatgatgggttgatgtgtacagcaaaccaccatggcacatgtatacctatgtaacaaacctgcactttctgcacatgtatcccagaacttaaagtgtaattttaaaaattaactcaaaatggattaaaggcctaaatatgagagctaaaactataaaattcttagaaaaaacataggagtaaatctttgtgatcttggatttggcaatggatttttagatatgacaccagaagctcaagtaacaaaagaaaaaataaatagataaatagtgatatggtttggctctgtgtccccacccaaatttcatgtcaaattgtaatccccacatgtcgagggaggaacttggtggaaggtgattgggtcatgggggcagtttcccccatgctgttctcgtgatagtgagtgtgttctcatgagagccgatggcttaaaagtgtgtggcatccccgcttgcactctctctctactgccaccatgtaagacgtgccttgcttcccctttatcctctgccatgattgaactgtgagtcaattaaacctcttttctttataaattacccagtctcaggtagttctttatagcagtgagaatggactaatacaaatggatttcataaaaattaaaaatgttcgtgcatcaaaggttactaggaagaaaatgaaaagatgacctacgtaatggaagaatatatttgcaaattatatatctgataagtcttggatctgaaacatataaagaactctttcttactaataggaattctttttattgaattcttaaggaattcaataataaaaatttaaataacccaattagaaaataaaaaaagatgtgaatagacatttctccaaacaagaaagatatacaaatatattttccaaagatatataaatggccaacaagtacatgaaaagatgctcaacatcaccagttggcagggaaatacaactcaaaaccataatgagatgccatttcacacccactagaatggctagaatgaaaaattcaattcagataataacacgcattggcaaggttgtggagaaattggaacacccatacactgctggtggtgcccccatacattgctggtgttaaagtggtccagccactttggaaaacagtctagcagtgcctcaaaaggttaaatatataacggccatttgacccaacaattccactcctaggtatatatcccagagaaataaaaacatatatctgccccaaaacttatacacaaatgttcacagcagtattattcacaatagccaaaaggtggaaacaacccaaatatccattaactgatgaatggataaaatgtggtatagtcatgcaatggacagtcagtagcaaaaaggatgaaattctgatacatgctacaacatgaatgaaccttgaaaacattataatgagtacaagaagtcaataagaaaagaccagcttccactcatgtgaaatgtccagaataggtaaatccacagagacagaaagcagattaatgatttctagggcctggcgggcgttgggggaaggttgaatagggaggactggtcaatgggtacaggagtttatttttgaggtgatgaaaaagttccaaaatttattatgatgatgattgtacaactctgtggatttacaaaaaacgttgaattttaccgtttaagtggtttaattgtataatatatgaattatatctcaataaaactgctaccaaaaaagaaatcaagttcttgatgcatgattttaaataaatgacccttgaaaacatagtaagtgaaaggaagccagtcaaaaatagccacatattgtataattcattcatgggaaatgttcccaataggcaaatccatagaggcagaaagcagatcagtggtttgaaagaggataggggaatggagaatgactgctactgggcgcagggtttctttttagggtgacaaaatgtcctaaaattgggtaatagtgatagctgcacatgctaaaaggtagaactttgtagtatgtgaattatatttcaagaaagctgttatatagaaacataaaaattttaaatgataaaagttattcctgttaggtaggagaaaatgtgtatgtttatataaaagatgagattagacacgaaaaaataaaggaagaaaagaagaaaaaagcaagtaagctgatacatgctacaacatgaatgactcttgaaaacatgctaagtgaaaacatactaagtgaaacaacctttgtatgattccacttacatgaaatatccagaataagaaaatttatagaggcagaaagtagattagtggttatttaggggggaacctgttaattggtacagggtttcttttagggaggggtagcaatgtttaaaaacagataaaataaactttaaaatgtttaaatgccctttttgtacttattatctttattacaaaacaatacatttatgttagcacttaaaaaaaatcttcaaatggtaactagagtagcagcttgggcattgtggggctagcacctgccctgtcattatgagcctgtggggacttcatatggatatatttgataatgacacactataaggacaatctcatgttatggggattaaaacagaacccgctctaagatggcttgtgggccaacaggagaggagaggagagagatgtctgctgctttttactaaactcctacttaccttttccctataaaactctgctatccaggtggccctggtgttggaagcaacgtagtctgctttataaaacagcagtccagcagaaaattactgtgactctctagataaacacttaatggatatatatatgattgatccagcattgagaatgtaatgtttccagacatctctatatacacgcatacgctcagtatgcacatataacacgctttcattcactgctgctctatgatctactggctcaaatcaggttcagaaccagtgtagcatctgtgactaccttgcctcctctgctttttgcagaaaaagtgagaggaaatcttgggctatgagtgggcttagaaatgtctctcatttccatgctgtgcattaaccaaagtgaaatggttgaattggctctatagtgccaagccctccctgatcaaaagattaaattagcaccagttgtggccaagtctgtcagaaatgaaaactcttgtccacttaacatatcttgtgctcattgatctgttccctggaggcgaaaataaaaataaaaataaaaactcccaaacaaaatctcagccttaattaagggcagtgaagtatattattacaacagcactcattaagaaatcaaatgaaggaacgggatttgtccattccatcagatacggcttaatacagtcttggaaatagatgctggtcctatggtacaggccaggggaaggctggtcataagtttcgttatgactaattgcttcagtgaatgaaaaaagctgatctcccttctccggagtgacattttccagggtttcttcccctagcacattaagcagaagactgagaccaggggtgatcttcaggccccctaagttatattatttgaatttccttgcacacaaaaaaatcccccccttctctctctctctctctctcaggttcacatgtgcacacacttctggaaaggaaggaacaagtaaaagggagaaatgtagaactttagcagagatagtaaacctgaatgcccctccctgacctccccctgggttttagcagggctagtcttagtcttactgaacactgcaaggcaatgggctataatagtattacttgtgaggtactacataagcccctctttcaaaaccgtctgccctactcccagcaagactacttgaaattccttacactggatgcactcatgaaggttgttcttaaggagccatatatgataactatcaggccattatgttatagaatgtattgggggagatattggggacagtataacatgtcagctaactgcctcattccctcaaggctttgcctggttggagcgggcagcaggactggtgagctctgtggggagtccagataagtctggcatttaaggccagaagaacaggcctaagcagaacttcatagagggggatctgattgatccagagacagctgggaatcctaggtgtccagatagcacaataggatgtggaaatttgggcactgcagatgaatatctgaacagcggtggcagtggtagctggaaacagtcttccccatgccccctgtgactatagcatttcccctagtctcctgaaatggagggagaaagggatctgggctgtttgcttgcatgtgtgtttttacagcaacacagtgatctcatgctcatgacccaccccactcccagctagatagctttactataggaggctttcatcacttgttatgagatcttggctagatcggtagtctgagagccaggcaagcaaaccagaccaagcctcctgaatgacgtaggcccttcttaccagatcaaacaggccttcagctcctcattggctgcaggccccacatctcaagttattttagttgcgacaggcagggcttccctgaatatctgcaccctcttattcagtgctctcgggaagtggggtatgcatttgccatgctccaacccactgagatgtgcagctcagacaacaaacatgcatatgcacacagagaaaagcaccacccccctcccccggacatgactgcattggcaatggctgcaagcctggcccccacaggtggggactcttggtgtccctggtgatttggctgccgaaaggtgacctagatccaactgcctgcctcttcccctgtccccatcactctccaccgcatctgagctcacctggccttagttggttgattttcccgaacgggctgcagagaagagatgttaatgttgctgctggacaagctcagttctagcatttcttcttcctgggtatcttcggcttctttttccttcttcttaacaaaaaagctcttaagggctttaaatttgcatttcttctttcctggaagtgaaaaatgaaaatgaggcagagtgtgatggtagaagggaagacaggagaggaaaaagagccttcatgagaggaaagaggaccatgatcccacccaggtgtcctgcagagcttggactcaaccccaatgctgacagcacccttcaacattcatttgattagtcgtccccttaataactcagtaacaaagtgtctgagttactggtaaaagcagaagcccaggccacagcttgtcatctctgggcagctgctattcaggccaaactcactaggaattcacttgcctctcaatttcagctattaacatatacacctctttctttgtcctaagaagttcattcatgtgaagcaatgattgaggcaatgaaagcacttagtactcccctgactctaccccagtggctggagtcattgcaatccaataggagagccaagctcccacatgtgaaaaacacttcagaacccttagaaatccaagtctaagtggcagttgatacttcctagcctgcgtgctcaaaggatgcagacccaaagagtgagtgcggttggttagtgcagtccaggaacacttccttgaggaaggaatttatgagcaagggagatggccgggaatcagaaagaagaaagggctgcccaggcaaagaagctgcctgtgtaaaaggcatgtcaaaatcagataccaaagagtttttcaaggagtgtgtgtgtgtgtgtgtgtgtgatgatgatcattgtgtgtgttcttcaagtcttgccaattggtttggattatctacagggctgctgccctttgcacatgcagataaatgagagtttgctctatctataataattaccagggcagcagtgaggagtgtgagttttaaatgcccttaaggtgctgtctgtttgggctttactttttttttttttttttgagacagagcctcactctatcacccaggctggagtgtgatggcatgatcacggcccactgcaacttccacctcctgggctcaagccatcctcgcaccttgcaccttgcacctcagtcccaccccagtagctgggactataagcacgcaccaccacacgtggctaatttttggattttttgtagagacgacgctctagaaactagagttgagttctagaactagagttgagttctagtctcaaacgcgaactcttgggctcaagtgatccacccgccttggcctcccaaagtgctacaattacaggcatgagccaccacgccgggcctctttagtttcttaataagcacatatgtctttattgtgcttattaagaaactaaaggggagaagggggagagggctcgtgctgcattcttcaaagggaaggaattagctcttattgatttcacatgcaacaagtgccaactaagttgtctcattccaagtctcaactgtctggtctccagaaggtctcatcagcacagcaattctgtgctggcaatgaagggtccagacaagggagttgccaatgcagcagccatcatgaaaggcttaatggtgtaatggaaagcaccatccaagagtcagaaaattctggaatcctaggcttgaattcactatcaattagctctgtgacctggagtaggtcactcaacctctctgggactcagcaggaaaattaaagaattgcacctgatcagcatctcccaaagtgtgttcagagggatgctcataagatttgttgtatgagaaagggatccgtagtccagtcaatctggaaaattctggattagacaaagttcagtagcctgcttttcaacaaaacttttctgaaacttcaaaatggttatgtatatggtgaagttccaagaaaccaggcaacaatattatctcccaatgtatgtaagcggaatgtctggcaaaaaacactttgagaaatgctgaactagagttcctttagctttgaaatgctatgacttatttgtgcaccgattactcctgagcctgccagggtaaaggttcctaaacttcaaggcctgccttaagtccagtttcccaccaatcagtgaaactcatgcttctctctatcttctgaacacctaaaacttggctgttagcatcaaaagttttgcatctgaatgttcttagcctcctcactcattcattcgttcattcatctattcaacaaatatttattaaggtcaagtacttaccatgttctgggtatccgtgagaaagaaagaagttatagctccctatgtcttagctaccgcccctacatcaaggctgtaggcaagccctccttagcatcccccttagcaactagcacagtgcaaggcatgcagtaacagctgtgtccactggggagcgcagaataccaacacagcttgtcacttcctttgacttgagaccactgaacagagtcatccttcagcatacgataatttaaacactggcccttataaggagttgatgcaaattatagatgacataggtaaagagcttagcatatgatctggcatgtagtaagtgttcaataaatgtgagctagtgttagggactcagtaattacttgtttatcagggctggattcaattctatctcattagaagcagccccatatctataactgaatagtgaactgtacaatatgcataattggaggcagaagccagcatggagtagagcaacgaaagattatagaactgtttgcttgataattgctgcttaagtaatttctgttttggatgacttgggcaatttcttatctactagaatttgcctatataggggcatggttgggaaaacttggcaattctacctaaagagagaaagaataaaaaatgaaaatgaaataggaaacgtatattttctgcaagatcccttttaaaagtgttttcagaaaaaaataatttctacaataataaaatatttaaggctgggcatggtggctcacacctgtaatcccagcactttgggaagccaaggcaggaggattgcttgagctcaggagttcgagaccagcc[328 bp omitted]aaaaaaaaaaaaaaagaaagaaagaaaagaaaagaaaaattagctgggggtggtggttagtgcctgcactcccagctactcaggaggctgaaacagggggattgcttgagcccaggaggttgaagctgcagtgagctatgacaatgccactgtactctcccctgggcaaggaagtgagatccttctacctctgcctcccaaggtgccaggattacaggtatgagctactgtgcccagacgatttattgattcttgacaggtggatctcattctggccttctgaaaggggaacaactttatgctcagaagatttagaaacacagcaattgttgcccctcttgcttcaaaatcccatagtggaagagaggaaagcaaagctaggattccctagcaattcctgagttgcaaacctgcttctaataatccagcaaagacagggagaagagagtcagcagctaatagccatttgtgacacaatctataaacactgactaactggataaaaacatgtctaataaactatttaggctgtaataatgaattcaacaaacaatcattgtatgagcagaaaaattgtacattaacacatttttatgttcctaaattaacaaaatgactagtgactttggaactgtaacaggtgctgaaagttaagtatgcatatagtccaatttccccccaattttccattcttttctgggcagaaacaacttattttcccgcaaagattcaaaaatagctaaagcaatgggtgtctcttttaaccatggaccctagaagaaaaagaatgtttccattccatcctgtagtgtggctctgagtgtggtggtggtatagctttgttagcagggagctggggagacacggagagatggtaactgccaaatatggtaggttggctgctgttgctctaggtcagtggcttgaaagctggatacggcctttgtgacaacccattgccagacatacaatgtcagtagcaagggtctatgtcttcagcctgctttccattaggagaccgccctatccctaactgtatccaacaccccccacccccactatcccatgaatgaagacgagccctggtctcagccctgggagtgagatacaaagctgggtactgtccatgtgctatgttgcttttgaaaccctaatggaatctgagatggttgccatatattcaagtctataaatttggcctttgaagctttcttttttaaagtgtggtgggggcacctttcaatcaccagcagctaagccctccacaggctgtttttcaaaatctaggaaaagcacaaagagtagagagatctagacagcaggtatgggtaaaaactcacatttgtacccagcaatgtttatatgggtcacctatacactggataacttatgccatcacagggtacagcagttgcagtcagtgagctgacagctgagagctgacagctgtctggacttctataacaaagccactgatttccctgtctcagcccaaagactatgcattcccaagcagcaagtaactttcaacatactcatccagtcatggtctgcagtgtgtcacatgccagaaaacagctcattgaaggctgttttttctccagggaagaaaacacagctaaatctaatgagaaatggttgcctctaagttgtatatttgcttatccacaatgcatacaggcagcccatctgaattgaaatgaatgagcttttaaaatacatcgcataatgatgactttgttcttttgcattgctgcttggaaagaaatttatttttttagtttttatttattattttttttttttgagacggagtctcgcactgtcacccaggctagagtgcagtgatgcaatctcggctcactgcaacctccacctcccgggttcacgccattcttctgcctcagcctcccaagaagctgggactacaggcatccgccaccacgcccagctaattttttgtatttttaatagagacagggtttcaccgtgttagacaggatggtctcctgacctcgtgatctgcccgcctaggcctcccaacgtgctgggattacaggcgtgagccagcgcgcccggcattttttttttttttttttttttgagatggagtcttgctctgtagcccaggctggagtacagtggcgcgatctcagcttgctgcaacttccacctcccagtttcaagtgattcttttgcctcagcctcccgagtagctggaactacagacgcctgcaaccacacctggctaatttttaaaaatatttttagtagagacagggtttcaccgtgttgaccaggctggtcttgaactcctgacctcaagtgatccagccacctcggcctcccaaagtgctgagattacaggcgtgagccaccacgcccagctggaaagaaaacatttctaactaaactttcttccctttaacctcccaacagccaccttattctctggccagccctgactagttctaaaacttctaaaactgtactcaaatatttggtcttacaaaaaacaaacttgagaacagagaaaaggcatttcgttgctaccactcttcatcaagatatcctgtgctgccaccttcttttataggcatctgtttagttcatatccaaaaagtcaattggtttggtagttgggtttgctttggtgagaaggcctttcactcatttattcattcattcattcattaaatattttggagtgcctaatctctttctctctttttctctctgtctctctctctctctgagacacaatactaaacagtgataacacagagatgaagaagacccaagcactgccattaagaatctgtgatcaggctctcagcatcccctgccccacatcatgtgtgaagccaggcccccaggaagccacaaggaggtttccctctgttcttccagacaaagttttctgtaccatacaccactaaagaaaactcagcaaaagaatggaagaacaacccaaagaactgttcaattcaattctgtctttacactcaatgtctcacattgcatcttatgatttcctttttattgtgtgtgtgtgtgtaaagcttatcattgtttagtgacatttgcctccctttctaattattccatgcatgatcacctatcactcatagattgtgccacaatttaggcaatggatacacgagtaagttttgccaaagagaatttttgtaaatttaatcctatttaacagaagcctgtggaggcatcttttgtttctacctccttttactcctcaacaaattaatctctttcttagatctgaattactatctacagcaaaacctcagctgaatttgtcagatcatggtctgttctgattggttttttctgatgaagcagaaaaagccttagtaagtaaaacctggtaaccattttcaaagaagattgcaggacctcaggcaaatctttgactatcagagttggaggtgccaaagaagaaattagaaaactgaaaagtaaacgtgactgagtctaatgatctgaacttgttttcttgtgccttgcttctttgtcctaggagctaaataaacacagtaaacaaatctaattctggttatcaaagttttattgggttacttaccctcatcaccggcctccagaacatccagactgtcagaaatttcacttagtgattcagccattgtaggatgactaaaataaaatacaaagcaaaaaagcaaaatatcatcatttgatattcagggcgtaatgcaatcctttcaccctaccccttatccttcagttatattcttaaaatagcctagaaaaaatatacaaatggaattgccattacagagaattatccttcctttaaaaaagacaatgattccaaatgattccatttacataaaatgtccagaataggcaaatacgtagacacagagaatgtcttgctcagggctgggaggatgttttttgttttgttttgttttggtggggggggcgttggtaaagtgtacaagatttcttttttgttttgtttttttgtttgcttgttttttgttttttgtttttttacaggatcttgctctgttactcaggctggagtgcagtggtgtgatcgcagcttactgcagcctcaacctcccaggctcaggcaaaactctcacctcagtctcccaagtagttgggactacaggcgcatgccacaacacccaactaatttttgaatttttagtacggacagggtcttgctatgttgaactagaactcctgagctcaagcaattctcctgccttggcgtcccaaagtcctgggattacaggcatgagccactgtgcccagataaggtttctttttgagatgatgaaaatgttctaaaattgatcgtggtgatggttgcacaaatctgtgactgtatttaaaaccattgaattgtatactttaaataggtgacttgtatagtatgtgaattatagctcaataaagctgttaccaaaaaaagacaaatgcaaaaaacctgatctattgttttgtgggttggggcccattaactctggatgcctattactattcacgggtgtgcccagggagacaaaattgttttgataaacacacagagccataaagaaaagactgaaacatctgactacatgaaaatttcaggccgggtacagtggctcaagcctgtaatcccagcactttgggaggcaaaggcaggaggatcacttgagcccaggagttttgagttgaggctgggcaatatggcaaaacctcatctctacaaaaattttttttaatagctgggcattgtggcatgtgcctgtagtcccagctactagggaggctgaggcgggaggatcacttgaacccaggagattgaggccgtagtcagccatgatcatgccactgcactgtagcctgagtgacagagcaggaccctgtctcaaaaaaaaaaaaaagtgaaacttatggagaagaaataagtcaataaaagaatgacaaactagaaaacaatactagcaacaaatataacagatacaggggccaaatttcttaatttataaagagctcatataaatcaataaaagacaaacaacttggtctaaaagggacaaagactacaaagcagttagcagaaaaagaaatacaaataatcacatatgaagaggctccatcccactgacaattaaagagatagaaataaacatatcaaataagtattgtcatctatcagattgtcaaaatccttaatttggatgatattacattgctgacgaaggtgggaaaaaatagggactctcatgcactctggagtgagtagttctaactctctaaagagcaatttggcaatacctatcaaaatttaaaatgcacataccttttgatccaggaacatcacttctcgaacattaccttatagataaatagtcacacttgcacacaataatatacatacaagaatgtgtatcacagcattgtttccaatagttaaaaacgggaaacaaccaaagtgatcatgaaaaggatagttctcccatgactcactccatgtcatgcttctaaggaagcatgtcggttgataatcaaacttttagaaatcaatgctgacattatttttagagacagcgccttgctctgttgcccaggctggagtgcagtggtgcaatcatagttcactgcagcctcaacctccttggctgaagagatcctcccacctcagccttcatagcagctgggagtacaggcgtgctccaccatgcccagctaatacatatatatatatatatatatatttttttttttttttttttggagagatggggtctcactctgtgcccaggctagtcttgaactcaagtgattcccctgccttggcctcccaaagtgctgggattacaggcatgagccactgtgcctgtcccaatgctttcattcttgatgaaagtttgtgtggggggtgggggtggggtgggagggagatctgaggagcaccacaacccagagaaagggtgctatagtcatctgtgccagaaggccatagaaaggcaagcagagactttgtgcctatgataactctccttgaggtcttgatgtaactgaatgaactattgtaaagtggggttaagtagattctggaatccccttgccactccagatctgctcttttcccagacatagctatgctgccattgctgtttcatgggtgggcttcaggcccatcctgtcctgctttctagctgtaaacccctgatgtatctccagaggtggggggccggggggcggggctggtgaccacaggctctaaggctaaggagaacttgagagttcacatagccagagtgactgaagccttggagtgcaaaaggttccaaatcaccatgagaactgacagggctgtggtgtcaagattgcttcagacccacttactgagatgccctgtggttccccacaattccccctcactgccacaggtaataaacccaatttgttcaacgacaggtatgttcctggctgaaaggtattgatattttaagtcactcaacttttatgagttaatattacaattctgcctaaagatgacttgagtcccaggcccacacagtgatcaataattaccccgctcacacacacatggagacacatgcacacacacaccctctccactccaataaccataccgcctttcttatcatatgcagaccatcaggagagcccacatcaatggatttacacaccaatgcattgtcccagaatgaatggctttacccttggcattcctgtctctgctagttttccaagatctggagatctggcaggagcaaagaggaaggaaaattcaacatctgactggacacagtggctcacacctgtaatcccaacaatttggaaggccaaggtgggtggattgcttgagcccagggctttgagaccagcctgggcaacatggcaaaaccccatctctagaaaaaatacaaaacaaattagctgaatgtggtggtgcatgcctgtagtcccagctactcaggaagctgaggtgagaggatcacttgagcctgggaggtcgagggtacagtgagccaagatcatgccactgcactccagccagggtgacagggtgagaacctgtctcaaaaaaaaaaaaaaatattcaaaagctcttaggaaattcagagggagaacaggaggagtttgtgtcattggtaagttcctggccatcttaataaacacagcagcacccccacccctgccactttagaagcctttttagacattggggaaataaactatcttagagaagcctgtgggaaaaaaagcccgttaaccacaatgtggggccatggtaggctaacattgtcattgacctaccactgtcaagtgtagaagatagaaagggaaaaaaaaaacactaaagagaaaaatatgaaagatgagggagaacaaagaaagagggcatcttggctacatctgaacttttagagcactaatagaatcattgcatttaacccttgagcttagactgtcctgtctgaaattctttgtagcatacttgccttatttccctaaccaaatcctaaaagccctgaggcttttagcaggcactctgttgacaacaccaccatcaaccaatccagctggacatgtggaactgtctcctctcctaaacaacccagcaactacagcaaaacacaaatctccccttgagttcaaattctcttcctgttaccatcccattcctctgcatctctttaaagtaaaattctttaaagagttatctatacttactgcctttatgtcctcactttctattctcgtgagctctccaatcaggcttccaaactgaactgcttccaagccagtccaccaacactgcgcttgctgaatccaccagttcctttaactttcagcagcatctgacgtgattggccacgcccttctttttgaataattttatcacttgtcttctggaacaccacactcccttaattttcctcctaccttattggctgttccttctgggtcgcctttgctggatctctctcctctccctgattttgaaatgtagcactgcagggctctgtccttggctctcttctttgtctacaatcacttcctagaacctcaccattaaatagaaaagttaacctgagcagaattgcaagccacgtattttcaattttctagtagctacatttttaacaagaaaaaagaaacaggtgagactgcttttaataatatattttatttaacccaatataaccaccatattatgattatttcaacatatagtcactacaaaaataatattaatagtatattttacattatttttgttcacagtaagctgccacatcagctgcatcagcctcctgctccaaatccccagtggcttcccatcaagctgagagtaaaatcccagccccttaccatgggccttatgtgatgcaagcccacccccatgctccactgatcaccaaacccgctacccccctacttcatcccttcacctagcctcactggccctcctggtaatgccccctttcaatctcaggatctttgcatttgctgctttctctgcctggaggactctttccccacatagttgcatggctggctttcttgcatcattcaagcatccaatgttacttcccccagagagcacgtccatgatcatcctagttaaaatgctcccactctctctccatcccattattctttttttatttattttttatttttcatttattttttgagatggagtttcactctttatgcccaggctggagtgcaatggcgcaatcttggctcactgcaacctccgccacccgggttcaagtaactctcctgcctcagcctcccaagtagctgggattacagacgtgacacaccactccctgctaattgtgtatttttagtagagacggggtttctccatgttggtcaggctggtctcaaactcccgacctcaggtgatctgcccacctcggccccccaaagtgctgggattactggcgtgagccactgtgccaggccaattattctttattaacatcttcatagccctcactgctgcctaaaattatattctatgttaattactagttttttgtctatctcctcaactagaatgtaaattccataaggtcaggggccttgtctattttgatcatcattgaatctcccaggacccagaatagtgcctagaatgaaagaggcaaaagatttactgttggatcagatgtggtgtgtcaggggaatagcaggcactcaataaacgtttgttgaatgaatgcataaattcaataaaagaaaaaaaattcttcaattttttattgaaaaattcaataaaatccacctttgtggatttcactctgagcttgatggcaagtcactggggggtttggagcagggggctgatgcagctgatgtggcagcttagtgtgaacaaaaataatgtaaaatatatcattaatattatttttatagtgattatatgttgaaatagtcataatatggtggttatattgggttaagtaaaatatattattaaaataaaaagtggttcctatcaaagaaccacctttgtggtcagaaatttcttcagacacagaggcatgctatacggggcagaggaagacttgtcctagcagaagaacccccttgttttccagtttagcaagacctgtcttccctcccagccctgggttattcacctgtacagaatcaagcactcttggacccctctttcccttgatacacagatcccattcctagatatcctagccacgtgaaccgtgagtgtggagccccattcagctgggctaggtctggaccctcatggagaaagatgtttcaataaaagaaacgctgcctcttcctactttccagccaccaccttttctgtcctttttcccccacaagctgatcttattaaataatttccttcccaagtgtctccttttagaggcatcactgtatatttctttcacgtgcctcattatggctaataaaaatttaaaataaatttgtcccttaatcataccatgattcattggtagtgaccttggggctgcctcctctgagctatacgtttatttatgatatttagaaaaagctacagtcacctcacaatctcaaaaaaggcacagtgttctctctgaaatataaccatgagcctccccgcttaaacttgtccaccagcttcctgctgcctgcaagataaaagccaagttcttaacactcaaggccctctgcaatctggtgttctctgcccactggagggggtccagtctcccagcagcccacccctgactcacagccccatgctctgacctcccagaatcaccatgttcttttgttttctctgtgttccacacaggttgtgcacttggcttggaacatcgtctctctaattcccacatccttgaaattacacatatgcttcaagacccagctcaaaggtaccggccacccatgccccatgctctcagacctttgcgcatacctgttgtcatagttgatatcaccttgagaacagtgaccatgttttgattatctgagtattaccagcacctagcacaataccaggcacgcaggacgtgctcactatatatttttgtggatggatgaatgcagggggtggagagggtcttgcagtggcaaacagaaatcagtgggaaaagtggtcttttttaaacatatggggacacattgagacacactttcagtaaaagacccttctgcatgaagtcccatgaaaaagctggcaaaccgaatgagggaagaggaactatatgtttttatccagtaaattatgagaggctttcggaaccacttccaaggaccaaacatagtcatgtaataatggttatcaggaaacctggcagagcagaggtatcgagtctcgttatcaagtcattattaaagtgctttgtttgcttctctaggccaaccccagatgcttaggccccagagctgccttttccttctgaaactggctcatttgagggttgaacaagggttttgggggaaaaagaggggaaaaaaggggaaaaggcccttcttccaaggttgttgaatttttttaaaccacagcctgatttggcttcagggattcagaagacttttcctgacagctctgttgccctcccggaatggagaatgctaatggaaagcagctggcctcatgttgttggttttctttaaacaatgtaataggatgaaatgtatttcacagagtctgcggtaaacagaattctaagatgacccacaagattcccaccccctggtatgcatgtcctgtaaatcccctctccttcagtgtgggtggacctaacctaatcaggtgggcctctgaaaaggagggtttacatgctctcacttatacgtgggagctaaacattgcgtgcgcatggacataaagatgggaacgacagacactgggcactggggactactagaggggagaggatgggagggagcagcgttgaaaaactacctatagggtactatgctcacttcctgggtgatgggatcaatcatacccaaaacctcagtaacatgcaatttacccatgtaacaaacctacccatgtacccccgaacctaaaataaaagttgaaaaaataaacaaaacacacatttgaacatgagtaaataaaaggaggatttagagatcagataatagaagccagagagatcaaagctgcagcagatgctgtcctgttggccttggagtaaccaactgccatgttgtcgagggccacatggcagggcatggcaggacatgacatgtggcctctagtagctgagagaaccccttagctaacagccatcaagaaaccagggacctcaggcagggcacagtggctcacgcctataatcccagcactttgggaggccgaggcaaaggatcacttgagctcaggagtttgataccagcctgggcaacacaggaagacccgtctctactaaaaatacaaaacgtagccaggcatggtggtgcacacctgtagtcccagttaaggctgaggtgggaggattgattgcgcccatgaggttgaggctgcagtgagctgtgattgctccactctagcctgggtgacagagtgagaccctgcctcagagggggaacaaaaggaaatcaggaacctcagccctatagcctcaaaaaactgaattctgccaacaaccattcagtttaaaagataaccctgtacctcagaggagacctcagccctgacggcgattgagccttgtgagaccctgagcagaggactcagctaagcccagtctggactcttgactcatagaaactgagagatggtatatttgtgttgtcataagacagtattttttttgtcatttgtaacatagcaatagaagactaatagagtcctagaggctctagctctaattgcagatgaagccaaaactggggtaggtttggagccatgtaagctgcaacacagacctggtatagaagcacacgaggggattatatgctcccttcccccagcacaccccactgcaagcacttctttacgaagaacttaagttgctactctctcaagcaaattgtcagctggactgattagaccctgccaaaatgttagaacatgcaaaatccccttaaaggctcagcttgtttgagatggctttccctaccctcaggacaatgtctttaacccctttcaaactattttatttgagacagggtttcactctgttgcccaggctagagtggaatggcataatcatagttcactgtaaccttgaactcctgagctcaagcaagcctcctgcctgagcctcttgagtagctaggacttacaggcatgtgccaccatacccagctaattttttaaaaaacttttcttgttgggggggtcttgctatgttgcccaggctggtctcaaactactgggctcaagcaaccctcctgcctctgcctcccaaagtgctgggattacaggcatgagccactgcacccagcctttcaaactattgctgtactttgtgccctcaaccaagagtatgtgcatccaccaagcagtggctaaagagccctggagttgaacattctgaggtgtggtaaggggagagagtggtggtgattggattcttctagagggagcgtctgatgccaggacgccaactcattgaggaacgaggaaccacccaaaatgaaagtatcagaaagggcccctataccccttaattgcaaaataaagtatcctccaggggaaaggaggctataatcaccccacagcttcctcttttcttgcaggaggttggcaggagggcatcagaggtccagccagctcctgaaatgcagcccttggacactccgtaatgaagatggctgcccttcagatcacacaatgagctccagaagtcctactccacgagtccaccagtagtcagtatgattccattgtggaaagtcaccccactgattggcagagttcatttggtggggtaggggtttgataccaggttccacccaggatacaactacgtccatgcacaaatcagggctgtgggatatagacggaatgattggcatttgcccagcaggggccaagagcagcagcatttctcagcaagcccagggccagctagctagccttgaacttctgtttgtttgtgctcctaggagcaggtgtgagcaccctcacgggaacctgggtagaggaggagaacaatctttttttctttttcttttctttctttttttttttttttaaatactgtgtctcgctctgtcgccaggctggagtgcagtggtggaggagaacaatcttgatggccatttatgctggctctgagagccctgggtgggtatctacccaaagcagaaactgatgcatggctttggtggcacattattatattttttaatttggaaattttgtattgatacattatgtttgtacatatttatggggtacatgtcatactttgttacatgcatagaacatataatcatcaagtcggtatttagtagatattcatcacctcaaatatttgtgttgggaacatttcaagacctcttttgtggctattttgaaatatacaatatattattaattatagtcattctactctgctatggaacattagaactgattctttctatctaactgtatgtttgtattaaccaacctctcttcattcacccctgccacccatacacccttcccagtctctggtaactatcattctactctctaccgccatgagatcaactttttcatcttccacatatgaatgagaacatgtattatttgcctttctgtgcctgccttatttcacttaacataacatcctccaggctcattcacattgctgtgaatgacaggatttaattcttttacatagccaagtagtactccattgtgtatatatactgcatttcctttatccattcatctattgatggacagttagattaatttcacatcttcactactgcgatggcacactacttaaaatgacatcttcagcaaattcggcaaagtcaaccctccaaatgtccatggatgtcagcagcaagacataccagggagagaagatcatctttctacattccacaccctcacctgtgggtatttgaacatctggatcatcaaacagatgcccaaataggctctaggggatgcctgcctcagatacttgctgcaggacaattgtcactgaggcctttcttacacactagaaggccaaagaataatggaatccaccctctccacctcgccatcacgaggaagcccatttcagaaatacctctgagcaccctgattgtcatccagtgaacatgcaaagaacttggcctaaaaggtcctttctgagatctctctagtggcctagaagcctagcagacagggagtcctattccatcttacaatccacaaatcctgtgatcaaaggctctgttcttgtgcagtgaggggcaattaatattatgcaattaatccaactaatgaaattgctgagtcctcagtctgtgccaggcaggcactgtgaaaaattattttatgtgcattatctaattgagtcctcacaagagttctatgtagtaggcattgttattttgtttttattcttttcacacccacttcccagatgaggaaactgagtcttgctgaaattaggcagtctgtgcaaggtcatacacgttgtgagtaatagagttaggactcaaacccagttctggattttaaagcccatgattcgaccactacactcttctccttcctcacttggcaaaatctggtcaatttgaaatgcccactcactgctgccctagagaatcttccttactggtctattacatgacccgaaaatagaatagttcaccaggccattagcagcccccaacacctttgcagatatttgctgacattttaacaatgcacagagtcctgccaaaaatgacccactagatacatatattgtgatgagggatcttaagggagataggtctgcagcatggggacccttgggtggtcagactgaagtgctgttccagcattggggaggaggggcaggaaagcatgagaacactgggagactcaagagaaaagtcagaattgaggggccctaaggatggacttcacagctttgagtgtgtgttgggtgccaagagctctgcccccaaatgctctgctagttctcaagcccatcccagcagaatgtgtctaaggcttttgatcttgttgttgagttactgcagtagctgttattactgcttccagtggtcaataataacaccagttgagggaggaggta[222 bp omitted]gaggcagagaatagcttgaacctgggaggcagaggttgcaatgagccgagattgcgccactgcactccaacctggtgacagagcaagattccatctaaaacaaacaaacaaaaaaaaagtagaagaaagggggttgctagtggaggatgtgaattttacatagctcattggattctgtgggatttgatatagatatctcctgctcttagaattcaaaagccgtcaaggagtggagacaccaggagtcattttctggccaggggaggtaggggagataagggagaaagaacaaccagtcctctgcaatgtgtccccagcccaagctgaactatctgtgtcctttgtgcaggcacattgtaactttctggtttcatcttgcagccttttggcccacagggtggaggttggggaaagcaatctcagcatcaccccatggttatgagaaatagccttttggtctcccagttctggagggatatagaagtctctgagtgaatttcatcttagcaggaagggaatgggcataaggaggggtgatgctgatgtctttgtccccagagggcacatacccacagaaataacaatgccatggccaggtgcagtggctcatgcctgcaatcccagcactttgggaggctgaggccagaggatcacttgagcccaggagttcaagagcagcctgggcaacatggcaagaccccatctctacaaaaaaaaatttctgaaactttagaaaatttctaaaaatattttagaaaagaaataacgcctccaagaatctgagatcactggacattctcagtcaaggtgacatctgagaatttaggacctcagatttctttaaccctgatcccatgtacagccctgcagctcagcagaggcagctccctacctggagttgtgggaagagttatccgaaggttctctagccccaaatctttccttttaccccagccatggcatcaccctctctttctacctggcctaaaatatccaccatcagaatccttccccttgaaccagacagcaaagtcagaacattatttcccagagcctgtctcattagtaaccccaaggtctttatgcacagctactatgtgcttagacctgtttcaggtgctatgtaggcaatgacaaaataaaatcgttaacatttacttgacaatgaatatgtgcaaatgctgtttgaagtgcttcggatacatcatctcatttaatcctcagaacaatcctatgaggtaggtactagttattttcacttctctcccattttgtagatgaggaaacagaaaggctaagtaactgcccaggggcacatgacaagttcgaattctgaaggtaggatttgaatctaggcaatctgactccagagccaataagtgctacagaaaatgaccaattccctgatgacaaagagaaagaatacacatgaaacaattgagaatagaactacattaggaattacaaagcccgcgtcctgaaatctgctgttccaaaaagttgtccttgcagccttgcccgagtcatagcccctctttggacctcagttctcacatttgtaaaataagatgaggcaaaattatcatgtgttaggacaaggattctcagggttaaactctagggcaagcttgtccaacccatggctcctgtgccgcatgcggcccaggatggctttgaatgtggcccaacacaaattcatcaactttcttaaaacattatgagattttttttacaatttttttaagctcatcagctgtagttagtgtattttatgtgtgacccaagacaattcttcttccaatgtggcccagggaagccaaaacatgggccacccctgctctagggcactggctacatgtggaaggagtctgcaggccccaagagttgtggaacaaaaagctggagtgtactttgcttacatgtgtggtacagggggctagatgccagaaatgaggcagaggggtaagatcaagtcagaaaagggtgtccataacacatggcaaagctgagaatggcaaggaacagcaaagcaaggctagtatgctgagatttagatgtaaatgaggtcaaagaacaagggaaggtgaaactgaaggggaacaacataggaggccgtcaagctacagaagggaccagaaggtgcttttatgggtggctccatctacagcagaaaggactaaaagggacatttccatgcaggctgaagtcaccatgaaagactcaatagagaaggcagaagtttggtttggtttggttgtttttttttttttttttttttttttgagatggtgtctcgctctgtcacccaggctggagtgcaatggtgcaatcttggctcactgcaaactccgcctcccgggttcaagcaattctcatgcctcagcttcccgagtagctgggattacaggtgaccaccaccatgcccggctaatttttgtatttttagtagagacggggtttccccatgttggccaggctggtctcgaactcctgacctcaggtgatctgtccgccttggcctccaaaagtgctaggattacaggcatgagccactgcgccaggccgagaaggcggaacttaagatacgccaggtgctaggcagaaaagtttgctgacagcttgagcactgaggcactgagagtcagcacagatgagttacagatgaggacagagagggcaggtgacatccacaaaccctagtgagcaggaaggagtaaatgatgtgcccaggctcttcttcctagagtgtactacctggaaggaaaagaaaagtggcagtgaaccccaggagagcagaaatctgttgggcttctctaaacttcaggcacaagaatccctagtcagaatgacctaggaaaaagaaaaagccacactggagtagcatctgtcctcacagtgcccgggagaagctcctaaatgggggtggcaggtggttggcccctgacccagctggacactgccccgttgtccacttgagcatgagagaaaagcataccccagcatgtgaggaataaatgagatgcatagaaagtagcacagtgcctggcacaaagaaagtgctcaataaatagtgaggtttacaaaactcccatgacagataaaggcaaactgtgagcacagggtttaaggaggaaggctgtaagtcaagagcatgggtaacgatcactgattccttggcactcactcacagggatgctgcttcttcagagggagtggggcccagggacctgcaagtccagaaccttccaggtgactcctgggaggtgagggctccaaatacctagctttaaggaaaccctgctgtaaatcaccttgggtacagggcatggctgaaacagaaaacctgaattgggaagccataagaaatggatggcagctagagagtggattaatagacattggagcctcaggaaagtgggaaggtgggaggggagtggatggtgagaaattacctattgggtacaatgtatactattcgggtgttgggtgcactagaagcctaaacttcaccaagtatccacactatatcactcatataaagctcttggcaagaggcataacacacagtaagcactcgatacatgttcactgttattggtattactctcccttctgcacaagaaggctgtcctccccgtggtggtaatgacctgtgttccctgctcttcatcagtttccctaaagtaggggatgagatgttctgcagttacccacaatatatccatgtaacacaactgcacttgtacctcctacatctataaaaataataaataataaaaagaaatggatggtaggacagggcaagtgtggtgaagaaaaagcaatttgaatgatatctagagagaatcgtgaccacagatgaaggtatttttcttctaataaacacctctaagatgtgagtctccaatgaggcctctagcaatttttggacagttcaaaccccagctctgcaattaactagctgtgaggcctggggcacatggagtcctttcttggagcctccgtttactcccctaaggagtaaggggttgaactagacttgaagtctagggttatttttagctcaggcattcttggattctattatttcctgagatgatctttcaaagttcccagttcatcctagagtagccagattttgcagaggctcactataagccctccctgagtgggccaatggtggcccagccttcacagcaagactttcagaagcctgtcaatattgcagaaaactgtcttactttcagattgtttagaaaccaaagctatatttcccatttaaaaaatgcacaggccgggtgtggtggctcacacctgtaatcccagcaccctgggaggccgaggcaggtggattaactgaggtcaggagttcgagatcagcctggccgacatggtgaaaccccatctctactaaaaatacaaaacttagccgggtgtggtggcatgcggctgtaatcccagctattcaggaggctgaggcaggagaattgcttgaacccgggaggtagagattgcagtgagctgagattgcgccactgcactccagcctgagcgacgacagaacaagactctttcttaaaaaaaaaaaaaaaaaaaaaagcacaggttgcagatttaactaaaaattccctactcattatttcctccacttctaaagagaactacctcatcccaaagagtttcctccttcctctaactctgaagaagcaaacagaagccatttctgtataaaataagtctcaggatcattgatgtttggcttctggggccacaaggacaaaagaaacaaacattcttcacgtgtgaagttaaaattatgtccttcaaaaatagggcatggctgggcatggtggcacatgcctgtagtcccagctactggagatgctaaggcaagaggatcacctgagcccaggagttcaaggccagcctggacaacacagcaagaccccatttttaaaaagggttttggaggtttagtggggatattccccctcctctttccgttaacaggtttctggatacccctccaactatcacaaatgaacagtgaactaatgcagaaacctttgttaatatgcttgatggcaaactctagagaggaagctttccctgatctactgggttctagtgcaaatctgaggaggcagacgcgcccgtgctcccaggaccctttcctttctcccatgggctcagaagactctccctttgacttacttcactctccattttcccaggacagttgggcttatggaaagggaagatctaaatgcagtaaggaagaagtaccatgatccttagttcataggatgggctagttagtacttagctcatgaagttcacaggccaggaaataagaaataaagaccttgttaatgtaaaaatgcaacatgactttatcgaccttctgtagcaatatttttctgaaatacactgcctcctgtgctgttgctcttttcttactcatatctggactttcccaggtccatatctcttcttttcctgttctcttgtttctatttctcattttgaacatctcccttatatgttatagtagataactgaattacattgttctaagtttttgtgtttgtagcaagaaatatggttcaaaatgttcaaattagatgggtaaaatattttgtttctacttttagaagttcaagcaagttgatttaacaatatggggccctttgttaattttttcccctggggccttggcctcattagatgaaactctccctcttcctatcaggctggggaatttttgaggaccagaacctcagactaatgcagatcttgacaagctgagtggcctaaggtaagtcatataatcccttcatgcctcagtttcctgatttataaaatgaacatgataatagaagggtctggggacagaagttaggagatgaaggaagtaggtggaatgaaagaagtatgaacatcataagtcatctttgtgtagtgctcttgactctctgatccagtagtttctaagcagatatgcttttgtcacagaaagagaaatctggcacattgaccttctgagtaggaagcataacataattgtgaaagggttaggctatgacgctggacaaatctaggtttgaatcctagctcttgtcaattactaggtgtgtgatcttgggcaagacactgaactgctgaaaacctaaatttccttagctgataagtggggcttagtactttcatcataggctaactgtgaagattcattcatttaataattgttcattgagctcctgatatgtgctaagaagagcccagagcagtgctcaataaagagaagggccctgctctcacagacagcttggtgaactaactcactgtgtttgtccattttgaattgctacaagggaattgaggctgggtaatttaaaaagaaaagactttgattcggcttatcattctgcagcctgtacaagactaccagcatctgcttctggtgaggacctcaggaagcttctaatcatggcagaagtggagctggtttgtggagattacatggtgaaagaaaggaaggaggtgggcacagtgcctcacacctgtaatcccagcaccttgggaggccgaggtgggtgaatcacctgaggtcaggagttcaagaccagcctggccaacatggtgaaaccccatctctactaaaaatacaaaattaactgggcgtggtggtgcatgcctgtaatcccagctacaggaggctgaggcaggagaatcacttgaacccaggaggcagaggttgcagtgagccgagatcatgccactgcactccagcctgggcagcaaagtgagactccatctcaaaaaaaaaaaaaaaaaaaaaaagaggaaagagaggggaggaggtgccaggctctttttaacaaacagatctcatgtgaaataatagagtgagaactcactcattaccactggtagggcaccaagccattcatgcgggatccattcccatgacccacacacctcccactaggcttcaccttcaacactggggatcaggtttcgacatgggacttggaggggacaagtatctaaactatatcactcatataaagctcttggcatgaggcataacacacagtaagcactcaatacatgttcactattattggtattactctgtcttctccaccagaaggttttcctccccatggtgctaatgacctgtgttccctgctcttcatcagtttcccaaaagtgggggatgagactttctgcagttacccatactctctccatcagcctcccagtaaccagcaggtttgtccaatggttacctgcattgggggctggggcccatgggtgtgtgagggcaaagccaactggatccaacctgtgcccttggcccattagccaccattggatcaataggccacagatacggcttgagtttcaatcccagactcctgggaaaccagctgtccccagaaagcctctctctgggttcacagaatggagtgacttctttgaggcaagtatcaagcccaggtgaggctgctcaggctcctccttaactgtatttgtgaccacccaggccctgtgctttttatatttcacccgaggctattcttaaacagttcagactgctcttttggacactgtagtggcacagcaaggaaaatcctccccctttcctcttctccagaaaggactaaatggctttcctataccaacagcagaaactttcatttcctttggctgtcccagaagaacagaaatgggatcatgactacctaattggttaatggtcactctttgtttgtcaacataaggtgacaagggaactcatatttactgagggcaacctatgtgtgcctgccagttacctaatttaatctttgtgacaacaccatgaggtaggaatcatctccattttacaaatgagaaaattaaggctcagaaaggttaaggcattcacccatggccacatggctagtaagtagcattgtgaggattcaaacccatatttgactccaaagccccatgcactttctactatatggtaccaaaatattttccacgtgtgtacatatgtatctgtcagtccagacactctgcctaagtggctgaaccgttgggaagtatggcctttgatggcacactataagctgctcttctttccacttggaccacatgacttgctccttcattaggagcctgggaggcaggtttgcccatatagtgctctggcttcccagccccaaatgccaagcttcaatgcatccttaaaatggtgcctgggctgtcctgccatacactggtcaggtgaccaacagagcagggcctaacatcgtgaggaactcccggtttcctgctgctctctggtacaaccttcccaattcagacacttacattccaaatttaagacagttttaccaaggcaggacttttgtactgaatctggatgaaagcacagctgtgtaatgtgcaaacttttggcacaaaccttatgcttccagagggacttgtactcttcagagcacaacccaacaatgctgtagcatagacagctaggggagaagcactactatgattaccattttattattcccactttacagatgtggccaaagaggcatggggacatgactagaggaatcctgtgagggctgagagttggagctctgcctctgaagtggcctttaaatagtattccaggggaggtcttctttttaagccctgcacaagccccacttacatgatgacaattactatagttatcacaaatctctagcaataattgctaacatctctcaaattcttactgtgctagatactgctacatgttttatttctcatgcataatttaatttgatactcaccatcctgaaaagtaggtaccattgttacttcttgttttacagatgagaaaactgaggctcagaaggcctagatgacatactcaagaccataaagctagaaagtggtagactgtggacatgaaccaaggactatgctccactagaccatagtgcctctaacactgaatccaataggaaagccactagccacatgtggttgtttaattttaaattacttgcgataaaataaaattaaatactcagttcttcagttatgctagccaccctgcaagggctcagtagccacacgtggctagtggctatctcattggacaccacagatagaggtcatttccattatcacagaaacttcgagtgaacagtgctggtctaaacgctcttaaggtgggtcctcctcagacttctactttgggaaactgttattagtttaaggtagagtctcataatctcggcatgattgacatttggggctgcaaaattctttggtaggaggtagggagtggctcttcctgctcatccttggatgtttagccgcgtccctgggcctctaaccactagatgtcagtagcataccttggccccggttttgacaaccaaaaatgtctccagacattgcccaatgtcccctggggagcaaaattatcccccacatgcccctgccaccctccagttgagggtcaaggtaagtactatacatgcatttgaagtaatagcatgcaacaggggcctgcaacccccaagccacagaccactaccagtctgtagcctgttaggaaccgggccacacagcaggaggtgagtggcaggtgaggtgagcacatccagctgttaagagaacaagtacttaccttgactcagaagtactgggtcaaggcagtactatatatgcatttgaagtaatcaaatggcaagccttcactaacttaacttggccttctgaaagcaagccaattcactaaaactaatttcttctagtgaattataaagtttatagcaatttgaattgaatgggctgttttaatagctcttgaagatttcatgaaagagtaaaaccgtttaaagcagtagaaggagagtaaagatgccaagagggattactataatacattgtaggattcattcctcaaatttgctatccactgactataactatggaattgtgaaggaagcataagaagcagattggtttaaaaagctaaaagaatgctaaagtagaaaatcattaggaaatgacaagggcaatcacatcgcattttacattttggttactaatttccagaaataacacacaacaaaaaattatggtatatgagaaactgatgaaagaattctaaaaatgctaaagttgacacaactgaaaatgcactttcaaaggattcaaaagaagctagtgcacaaaaaataagtatatgaggtgatgggtatgttagttaccttgatttaatcattccacaatgtatacatatatcaaaacatcaggttgtacaccataaatatacacaaatattccattgtcaatcaagaaaatacataaatttctttaaagaaacaaatttaagcattcccatataatatgctgaaattttggctcctgatgaaataatatacttttccagattgttcatatattcccaaggaaaccaaacctccctacaacaagtggaacatcccttagaatgctgctaaagaccaaatgaaacctgtcaactacatctttagagacatctccaaaagctttaaaaccattttctcctaaatgaatttttgcaaagatttaaatactttatgttgtaaataactgaaagaaaaaactttaggtgaactggtaaatacggcaaataatttattcaagaaattgcccaagagccagtttccccctaactccttacagagggtgaggctgggggcctgggagagtatctcctccctctgacccctacactggtacctgccactccattggcacccatcaattctcctatcgctctcatgaatgaaaagtgcaactgagtgaatgcaagttagcaaaatgcgacacccagactgagccccttgccaggaaattagagttaacaatctttcttctaaaactagggggaaagaaaaaaaaaacaggaaagaagggagggagagaaggaagtgaagtgccacagggatctctaatgaccacattaaacacgtctaattacagtgaggagtggaagttgggtctgatctggcaggctaagctgcagctacacatttctggtgctttcaaatggcctaaatttgccttccctaactggaaggtgacatagagccaaatttcatgttcatcattgttctctccgtgcagctaggtatgccgcaaggtctcgggttccggagaactggttgcagatgctatgggaagatgggtccaggttggtagaggacacttcagggttggctgtcctctagcatctggattccagggggctgctcagggccaagaaagaatgcatggatcctcagaataccagcaactggacctcattacaagtcaatatttgtggcttctaatctcaaattgtaacccacactgcttccagggtcatcagggaagttttgcagccaaggggagcaggctgacacataatttacaatagtaattccctggtcaggtgtcaagtacctgttgcagaagctctcagcctcactttcctgaatcctgttcttggagtaggagaagctgactagcatgatgtgaggggcccactatcctggccagatccccaagattaccagcaatcactgcagtgccacaaaagcatccaggtcctgttgaaatacacattatcaggagttaatcattaatgtctactaacctatcatcacaggtcagttggctaagagctagccctgggccacaagatggcaatgtgttagccaagaggaagtccacggcctagaaggccagaggcctggagaagacaggcttggagagaagggcaaagttcaggcccagaacgcctggggtggaaggggtactgaaatcggaaatgggttgtaacaggagagactggggttgctaaaaacaaagttgccctgggctaggcacggtggttcatgcccgtaatcccaggccaaggtgagaggatcacttgagcccaggagtttgagaccagtctgggcaacatagcaagaccctgtctctataaaaagatttttttaaaattagccaggccatggtggtagacacctgtagtcccatctacttgggaggctgaggcaggaggatcacttgagcccaggagttcaaggctgcagggagctatgattgttccactgcactccagcctgggtgacagagtgagagaccctgttcaaaaacaacaacaacaaaaagttgcctgagctcaccattttgccttaggctgaattgacctctgcagcagtcccagagagaggccacagtatcccacaatgtatgcttttggtctactactcagatgacaatctttcctctatctgagctagacagctctgtgctgggagtcagggtactcaggagtctaatctttgtattgccactgactgtatgacccaaagagaatagctaaaaacctctggggcccactttgtttactcttaaagtgaagacattgtcacccaccccacaattacagggtcttgtcagattttaaaagttcttttgctttgccttcatctccttctatacttgtgcaatatggtatcacataatttaagcctactgctattttctcccttcttccaaaaagtgtattcaccaatctcttgataattctcctgtaaactgctgtccttctatctctatgaaaatagtaacagaacttaataactagttatcttgaacaagatctatatctacagtaactagtttggaatttaaaaacccaaactgggtttttaaactagagactcatttgattagagcaaagtgccaatgaggctcttggcatggagtcaaggcccacaagaatatggatggctgctctgaacatacccatttccaccactggccagacatttcaaacatctccacgatgagaaatgtatatatttatacataaaatctagactgcaattgtatgtgggagaggagactgtgaaccaatcctgtgtttctgcccaaatttgaatttcaaggcctattgggcttccttgagaaagtgcaaccctgctgatttggccaagttgtgatcctatgaaacctccttgtgttggggggaggtgggggtgttagggggatggagggtgcgagagtgcccaaggtttacgggggagcagtgagtgtttgagccagcaccatttccctcccagtcttcctctcccacaacacctggagcctaggaaaaagctcaaagaagaggacccgacagttcctccatgtgctcgcttccaagtgctcctactctcatttacattctctcctactgagcttatgtccccatcctctacctcttgcaaactgctgtttactggcctggtcaccccctaagaaggcaagctccttaagtgcatcttcgttcagtcaacaagattctttcaacaaatacttgtgccagacactgtgcttgcttggctccaggaggggaaaggaaaagtttctcccagagggagaaactagctttgtgccgaattgtcagggccaaatgaacccatgcaacgctcagtgattggagacttgcaatgagtgaggtgggtttctggctgtgattccaagttggaatagttaagggaaaagaagagtgttcactccatgattgaaaattggcaataatcatgtacactcacatacccactaattaaccatatgactaaatctattttggttaatatcttcttccttttggaattgcttgcaatacgtaaacatatgcacatacaacatccaaaaacaacactgtggacacataataagaatatactgcttgaatataataccccatcaagtaactgggagactgcatattgtacagcttggaataagtttagaaaattaagacaactcggaaaatttaaggtgattcttctctactcatccatgtttccctctctctttccatccctctctcggccttcctctcgtctctcttccacttcttggccccagtcccccatctcccttatctccctacaagatcatttattgtcagtcatgctagctgcttgctggctgcttactagtgccaaaacatcatgttctgatataattgaaccacattatttgacggaattattgctgtcagttatttgaatggtgttactaatcaatgaaatgagccttgtaaaatccaggtttgtgtggtgctttactttgagatgatgttggctaggtttcttgacacatagagaagctatagctttgtccagtctctctccctggtctgtctgttatataaacatcacccttgtgcagctctcccttctcagacttgagtcatttcttacaaactctgtcaaagtcaaggctgtaggagtgccacaaagtacccctgcaccaagtggtagggaatcgcggtgtgcagggcaggaagccccgggaataactaggtatttccaggtcagtcactgcagctgggccaagctcccccttggtgcttccctccttcttgcctttgtaagtcaaccaaagacaactgcaacagccttgggaatacgctcgacttccaatcctggcccctcggtccctggggcccaggtgagccaggtaggggtgccggccaggaaggagagaagcgtgaaaggcagagaagcctcgaggcgtccagccggccctcatttccccgcgtagagttgacctgtctctgtgtcccccgacctgccgagtcccagaagctgggttgaggactctcccgctgctgagctttcccactcacacgcacacgcacacctgcgcgagctctcccaggagggcaccgcccccaaccagcggggtgcacaggggaatgatgttgcaagttcgagcccagaggtgtctcgctgtcccccgcccacccccgggtcattcctcgccgcccgtttttgcggcgagagcaccatttgggcggttaggagcccctgcaaggccggctggcgttctgccaccctccactctgtggtgtctagggggagtaggtcggctgcgcccgccacttactctgaaatcttgaggcaagcatgaaagctagccatggtgctgctgagggagccgctggccggttacgtgccttgcctgctggggtgcatgggagcccgcgctgtgggcatgcccttagaggctgccacgtgggggcagctcggcacttcaagcgcccacccgcacgcagccccagacccacaggccgaagcaataaccagccagataaagtttcttctccaaggcctctcgctgtcttctgatctcagtccaaaaagggctgggcttgttccttacatggttaggaactgttaactccccttttccctctgtctccatcttcccgccacaacagcatccttagagcaaaataccagatgctctttcttagcctctctgtatccctgcagagctgagcgtgagaagtaatttggagatgaaaccctaaggaaagagtagaggcttttatccgagcaggaaaggacactcaagggctttgggaaggcgatgtaaataaatcgctttctggcattttagatggtgtgggatggagggagaggggagcagaggggagaagagagaggtcagggaagaaagaaaatttaagtagcaaggctgcaagcattcccatctagatgtgaacactgtttttgaggtgttctaagctgttcttgttcagtcttaaggaaaactatttactccctaagccagtctggggccatgaaccaaaaaagcaagaatttccttaaatttgtgaaatcttttctgccctcgagatgaaagtccctaccaaaggttgtgtgtacacggggaaccccaattataacatggcttacattacatggattcagagatgttgcagatcagattgtgtccacagaaaaccaaaagaactggagacagagacaacgagcaaaagtgtgacctaatgttgactgcctggaagacccagtagggcacctttcccaatctcagtcccataaagaggtgtgtgtccctaccttggcctctgagatgcacagatctgaaatattttgattttttaaaagtgcctagtgggagtgcgacacgcaaaacaaatgcagatgcaggcttttggctttttaaaatgacttttgaggaatcaagagtttcaaaagattgtgatttctcctgtgcatgtattcatgaggggcattaaacactgtctagctgggcctaatctgacaggctttccaaattgggtttgtccaaataagaataagaagaaagaagaaatttagctggggtcccttcagggggtcttcgcaagtctggtagcggaggcctgtttttcctttcagtctgaaataggcaacaccctgcttctggaatttcactgggtgggtaggctggggtctctggacagggcagtacatgtgaccctctcttattaactttggggaaaaggaacataactgagcaagaactagatttatgttgcagatgctaaagtctgacctgtggctagaatttctagctagaattcctttctaagtcaaatttgtggttagttctccattattcatatgtggctttgcttacccacttagtacatttcctgtaattgtgtttttaatcaaagaataacttctggaatacctacaccggttgtaatgtcagcaggctgttaagaaagaccaattttaatattggccagaaaagaagctaattagaaaggcaaatctatatcattcccttcccacccaaaaagaacacactttgaaaaacatgagctttggtgtttggataatgcatgctttgtgattctctgcctaactccttccttccattacttcaaataatcagaagtagagagtccacagaaaatccatcttataacccccaaactgcattgatggctccttctactgaaatctcatatcacctgtggtcaaggctctggggtcagagttgtgttcaaattctgactctggttaagtttctgaggtgcggtaactgcattgtgattgtgtaggaaaatgtctttgttcttaggagatacatgctgaagtatttagaaaggaagtgtaatgatatctgcaatttatgctcaattaggtcagaaaaaatgcataggagtgagtttgtgtgtgtgtgtgtgtagtgagagagagagaatgatgaagcaaatgtggtaaaatgttaatagttggtgaatgtaggtgaggcatatacgggtcttcattacagtattcttcaacttacctgtaattctgaagtgttttcaaaataaaaagttgggaatgagatgttagctctgcctgcctttaccaactgccttacagcaaattatttactctcttaaacctgagttcccttggctcaaaagtagagatattaatagaacccatctcaaagggttgttatgaggattaaaatgagataataagtgtgatgcctttagcatagtgcctgtcccttaggaaggtctcaataactgataggaattgctattatcataccattccattccacatcttattatatactgtcttttgttgtcctcgtggtgtttcaaatgcacataacttttctccttaacttagattagaagtctccagaggaaaaaaacacatttcttacattttcttttcttttctttctttcttttttttttttgagatggagtttcactctgtcacccaggtggagtgcagtggtgtgatctccactcactgcaacctctgcctccagggttcaagtgattcttgtgcctcagcctcccaagtaactgggattacaggcatgcaccaccacacccggctaatttttgtattttttgttgggacggagtttcaccatgttggccaggctggtctcgaactcctggcctcaagtgatccacctgccttagcctcccaaagtgcacatttttttcttatatctgcccatggtacagtgctgagtgaatcataggtagtgaataaaacaccttgttgagggactttgtggttactgttctgagggatctgtggtcatagcattgacttgaaaatgaccacatgcccaaaagccagtcattaggacagaccagtagaagaaaatgttagaataacacggtgggagctggataaggctggataagaagacaggactacaaaaacaaaaacaactatttggggaatagttttttttttttttaagctctgggttttggaaagtgttcatcctttgtaaatcccaagagggcatacattccattacttggcattccggatgcgtataacctctactaagaaagttgggcacattcttaagatgctggcccaataacgtagatttccaggtgcagcatagctcagccacttgcttccagcaaaagataaagtacaaacaccatgagtgaatccccccaaaccgcagttcctagataaatgcctccattgctttggggggaatctgatcttcctagctctaagaatgattccagtgagtctaaaacatgcaggataaatttaactgaaaccttcagggctgattcagaaactctaccaggctttttaaacatgcggctctggaaaaatctctataatcggccaggtgcagcagctcatgcctgtaaccccagcactttgggaggctgaggcgggtggatcacttgaggtcaggagttcgagaccagactggccaacatggtgaaacccgctttctactaaaagtacaaaaaattagccaggcatggtggctggcacctgtagtcccaggtgcttgggaggctgaggcatgagaatctcttgaacctgggaggcggaggttgcagtgagcagagattgcactcctgcactccagcctgggtgacagagcaagactccgtctggaaaaaaaaaaaagaaaagaaaagaaaagaaaaaaggaaaatctctataatcagtagatccagaaacggagaatagtgaaacgtccttacttctgaacaggggcaaaccattccagaaggtcgctctcagtctctgtctctcctccccttcctttggctcatgtctccctgctttctctttcccaatcccctcagcccacctcctgaggctcactgaatgagctcccactaaaggctggcaaaggtgtgggtgggtttaagggtgagaaatgagagagacaaagcggtttagtgtctaaatccatgtgaccctgctgattagagcatctcagatggagtgacatctcacgaagcccaggaggctgagttagagatctgagttatggcttctatggagccatttcaccaggcttctcagagtgccttgagaatatctgccctcacaacgctctagggaggctgggggcaagtgggaccaccagatccagagttgtccttaagggagctaggctggaggaaagtacacttggcagggcagggacctcccccagccctcccccaacatttgtaaacaggccaagtctgacataaattcacattatgggcaaaaaagtagggtggaggagagccaacaagatactatggtgggttagggggaggagaggatgccttctagggaggaatgcttacataatgatgcttatataggcatttgctaatggcagttatcagtcctgactacttcttcctccccctcttcccattcctcctcctctcccatcaggcagtattcagagtcattggacatctcttggctggggttggagtagtgggggaggacaaccagaaaagtcaccatgactcaccacactcctggctcgttcttgtagtggaggagatttagaggaagtctgtatagtatagaatgtctacagtacagttttattactttcgggctatatatccaataacacaacacaaacttggctctaggtgtggtcctaggggatctgcctgactgagcagagatgagtggagtttgtaactagacattgcgcaatgtttctaaacacacacctgtccatccacctgcccgcttgtttgcctgtatttcagattgtccccttcaggagtggaaactggaactcagatggggtcaatgatgctatcagtaaaggtgcaaggatgtggaaggcccttgccagtttcttgctggatgccttcatctcctttctcccggctgcacaaaactctaaaataattcgctccactccctccagctctctggtcctcaggagcctgaaaatggaacagtgctcaggaaggaggaggaacccaatttttttccctcacctccagccatggccaaagtcacagtctccaacctgaaaatccccagcagggagaaaacacacacatttatcactcacacttcacttagcccagagcttggaggggtgagacactgcccccacatgcagccttatccaaagcctgcacgcatcccctcccctcaacatcagccaagggagcaagggcccagccaggtatgccacccccattggaggagggacacttgcttggcatagtaaatggcatttttaccatctagccaggcagagaattcttctgccttccttggccaggcagctgagaggaaagcaaccccctgggactggaatcagtgattcacactggcttacccaaacagcctcctgctgtcattttctttccttccttccttccttaatatcctggagaaggagttttcagtacttcctcctgggctgctgacatcctgagctgagtgactggtcaatgggaaaagcagaggcatgtagccagggtacctggcctccaagaacttccccaaaagacaaagaaaaaaaatggctggaaaattctaatggtagacaaggtataaaatgatgaaacatgaaaacccatctctacccttcaccaccaccatgtccctacctacttcttggtttccttccaggaaacaaaagagccgtgtgtgtgcgtgtgtgtgtgtgtgtgtgtgtacctacatgtatgtatatatacacacacatatgtatatatacatatgtatgtacatacatacgcatatgtgtgcatataaatgtatgtatatgttaagtgtatgtgtatatataagttatcactatacatatatatttgttatcactatacatatacatatataagttatcactatatatatatatatatatatatatatatatatatatatatatatatatatctttgctatcttagcaatctcttcctcacaggccaaggtgttcctcatactttgataactgcagcctctcgaatgatccttgggaaggaaaatttgagaacagatacattggcttctctcttatactcagccccaaagtctctgtcctgcttccttagcatctcagagccttgctgtgtgcctggtgacaacagctggtaatagtaatcaagccaaagaatcgatgcattatttgtctcaaaacacaaagagcctaggcctgcggagagggtacccaaaagtggtgttaatggcaggaggttcgagtatcatgctgagtacagtgcagaggctatttgagttgaagtggggtgggggaaagaaaggtgtagattttcaggccaccccctacatgccacctactcaattactgaattgaactgccctgctgaattactgccatcctcaagatgacttagcatttatacttcaatgttcacctacacaagggacccaagaaaaggggataaacagaggaacagaaagggcttttctttttaaattaaactttttattttgaggtaggttcacatgcagttagttcacatgtaaattgtaagttatcacaagttgtaagagagatcccacataccctttacccagtttcccccaatggtaacatatcattaatataaaacttagtataatattaaaaccagaatattaacatcaatacagtcaagatgcagaacgttccatcactacagggatccctcatgttgcccttttatagccacacctatttccctcattccttttctttaacccctggaagtcacttatcttcatttctatacttccttcattttcatttgacatgttatataatggaatcatgtaatatgtaaagttttgggattggctttttttaacttaacataattctctggagattaatccacatcattctatgtatcaatacttcattcttattttgtcattgagtgtccatggtatggatgtatcacagtgtgcttaaccattcaccaatgaggcacagctgagttctttacagccagtctccatccagatgggagatatatttccttgaaaattcatgaaaagaatgtcaaacctcccggtatccaaggtgaaagcagagcccaagagcacacatagcagctatgtgcccacagactgctgaggctcaaaacctgacagttcacccaaagctctgggccctgcttctgcccagcagggcactgaggctaatgggtgctttcataaaggggtatgggagggaggcaggcgtcttattcagaaacttgaatctggacttcaaagcaactaaagaaatgaaatggcaaccgaatcccaggggagtgggggagcagaacttctgccaaatctgaaatctcttgcatttttttttctgaccttttgggcaagatgggggaggaggagtcactcctaaatgacttcctacagggcctatagggagatatatggtttctctcagcagtggttacctctggaatgagaattcagggtgggcaggatctttcctttttaaattaatgtagttatgaaccagatcgttttttcccacaatgagtatatattctacttttgtcatcatagaaacaactaattttaaaaagtcatggtagggtgtggcatgggggaatgaaaacaactgattggctgcaaaggtgttctgaatggagggtcccagttgaaaaatgtcttgggcattccttcactcctgcttttatttatttatttatttattttactttttacttttttgtgattaaaataaaactttttaatgagatattttgcatttgcattttctcacaagtctttaaaatggttattttacatgtaattttttatttttaagtcttgggggtacttagtaggtgtatatattcatagggtacatgacatattttgatacaggcaggcaataccatcacatcatggagaatggggtatccattccctcaagcatttatcctttggttactaaatccaattatattcttgttattttaaaatgtcaattaaattattattgactatagttgccctgttgtgctatcaaatactaggtcttattcattctttctatttttttggtacccattaaccacccccacctctcccccagctcctcactactcttcctaacatctggtaaccatccttctactctctatgtccctgactttgttttgatttttagatcccacaaataagtgggaacatgtgatttatttgtctatctgtttatctatctatctatctatctatctatctatctatctagttatttatttattttagaaacaagatcttgctctgtttcccaggctacagtgtagtggtgcaaacttaactcactgcagcctcaacctcctgggttgaagcaatcctcccacctcagcctccagagtagccaggcctacaggtgcacgccaccacatccagctaattttcttttttgaaatgttttgtagagacaaggtcttgtgatggtgcccaggctggtctcgagctcctggcctcaagcaatcttctcgcctaagcttcccaaattgctagtgctacaatttggaccaccgtgtgtagccccaccccatttaattttgggggcacccactctttaatgccctcctccaacccccagcttagtctcagtagactgaacatagcttcaggacctcagacaccgtgccccctgtcccctccaaacacaatgttttatctggactctgctcccacatgcaggaaactgctttctgatgcatgatgatgaaaagcatatatgggtcaatcagaatcagtcagattatgaaaaccctgttggagccaatgtgaaaaatctccagaaacacagtaccatcaacccgtggggaaagacataaggacctcaggaaattctttcatttttttctaatgctgataatgaatatttcagccacagcagtaggtttctcagttaggacagtttgactggacaatggccaggaccatctatgacagtaagattctgacccacaacctctacatccaccagccaggaaaccaaaccacagtctctcagcaatcactccagagcagtcaggacatggtcaatctcacatcccagatttactatctttgccactgtcccttccacttccaactcaggaataaccagagaaagtgaaataggtcccgcacaccaatcatgtaggatgccttgtttctagttaaactggtccagttttcccttgccaacagcctccaatcagggcatatgtttagccttcccttttttcactataaagctttgccaccccctgcctgcctttgagtctctgccaacccaaattgtggtggctgacccctttgctatagcaagctccggataaataccctcttttgttcttgtttgggtgatctttgtttattctacaatgtcctaccacatagctgggttcttgctccagcctgctacctgccactggccagggctgcccacaatgtccacactggcacacttgaactgttccaaccacattgaaatcgagcactttcatgattaagtactgtccccacagttgctaccgccttttggcaacttggtagcttggtgtagtgataaaaaatattaatattgaagccagaaactccagcatttattagctgcatgacttcaggcatgttacttaccctcattaccacatctgtcaggtggagggaataatgtcctctggatctcttttgtagaactgttgctgcatcttggagggaggcagccttgacctagagaggtatctaaatgtttgggtcccggtccctcaaagcagtggttttagccaagcgctcactgctaagcagtgggataagaagggaaaacttaacaatcctcaaagccttcatgtgggaagtatggatcaggctttggcccaagtcactgagaggttatcatacctggcttttcctgctcttctggcccacggccagggaaaagaatgcctgtccttctgatgggcttgcaaaaagatttattgaggaatgaatgaaaaggtccaagagtctttgttttcttcttatttagccacacatcggggcttttggaaagccacttaatcttcctgagtctcagtttccccatctgtaaaatagtaaaataacctccacccttcctgaatgactagatcattatgaagatgtgatggaataatgtatgtgaaggtatgtttaatttttttaagtgttatacagttgcaagtaacgattcttaggggacatatatttacaatggaagtcttggcaaagagaggccaaatgaggaaggcgaaggttcttcacgttttggagctgggctccaagttcaaccccaagggccctgccccttgcaaaggactctccctgactcctcgtgatcctagagtgccccagaagtggcttttccatgtcaatgagccctcattcttttcagagaatgctcagaaatgaaaaccctctcttgcgtctctcatacacagcacttaacagtctacaggccttcctcctatcctggctcctcacagaagccaggttttaaagctgggttgtttggtgacatctctgttctagaacatgctgcctgtatggccttaggcaaattacgtactctctgtaacccagtttccccatttgtaaaataaacatgaaaatgaagtagtacctacttcacggtattgttgggaagattaagtgagctgatatgtgtaaacacttaacagtgcctggcacttagtaggtgcttgataaaggttagttactgttattttcgggcagggcagggtatgctatccccattttagtcaactgtagaactaggatcaaaactgggacccttattctaagaaaagtcattttttttttgtcactctatcgcccaggctggagtgcagtggtgcaatcacagctcactgcagccttgacctcctagactcaagcaatccctccacctcagcctcccaagtagctgggatcacagacacatgccaccatgtcaggctaattttttgtagagacggggtttcaccatgttgtccaggctggtcttgaactcttaggctcaggcgatccacccacctcgacttcccaaagtgctgggattagaggcttgagtcactgtgcccagccttaagaaaagtcattctataaaactgagagcactcaaggaatacaagaaaatattaatatttgcaaaccatacatcagataagggattcatattagaatatatgaagaaaacatcaacaacaaaacaactcagttaaaaaacaggcaaaaaacctgaatagtcatttccccaaagaatagacaaatgaaaagataacaatcactaatcatcagggaaatgcaaatgaaaaccacaatgagatattactcagacccattaagatggatactttttttttttttttgagacagagtctccctctttcgcccaggccagactgcagtggtgttatctcggctcactgcaagctccgcctcccaggttcacgccattctcctgcctcagcctcccgaatagctgggactacaggcgtccgccac[175 bp omitted]aagtattggtgaggatgtggaaaaattggaactcttgtacactgttagtgggaatgcaaaatggtgcaactactatcaagagcaatacagtggttcctcacaaaattaaatagagaattacttcacaatccagaattctaattctggccatatactctaaagaattgaggccaggtgcggcggctcacgcctgtggtcccagcactttgggaggccgaggcaggcagatcacgaggtcaggagattaagaccatcctggctaacatggtgaaaccccatctctactaaaaattaaaaaaaaaatagctgggcgtggtggtgggcacctgtagtcccagctactcgggaggctgacgcaggagaatggagtgaacccaggaggcggaacttgcagtgagccgagatcgtgccagtgcactccagcctgggcgacagagagactctgtctcaaaaaaaaaaaaagaaaacaaaaacaaaaacaaaagaaaacaaaacaaaaaaaaatagaatggaaagcagggacttgaagagatatttgtgcacccatgttcacagcattattcacaatagcaactgaaatgttcatcaatggataaatggataaacaaatgtggtatatacacatgatagaatattattcagtcttgggaaggaaattctgacacgtactacaaaatcaatgaacgttgaaagcatgctaagtgaaataagccagtcacaaaaagacaaatattgtatgaatccacttgtttgaggtacctagagtgctcaaattcatagacacagcaagtagaatggtggttgctaggggttgtaggggtcagggggaatgtggagttaccatttaatgttacagtttcagttttgtgagatgaaatgagttccatagatggatggcaatgatggtagctcaataatgtgaatgtagttaatgccactaaattgtacacttttaaatggttcagatggtaaacactatatgtattttaccacaggcttaaatttgtttaaattttaaaattagtacagtggctggagaggatatagagacatggtataaaagaaagatcagaattgggaaaatgctactagaggaatagtgccagaccttttcccagcatgccacagttcccattatctagttaggctctttccagcctaatgatttctgctcaatttcagaaggacttttccctttggaatccaagaaagtaggaaatgaggtttacttatatgttaatacactacatatgttcaaagaaggaaaacaactcttttctttcctaagtagcaattgctcctcaaacagtatgacattttcaaaaggaacttgatcaagaacatcaccactcctattcaacatagtgttggaagttctggccagggtaattaggcaggagaaggaaataaagggtattcaattaggaaaagaggaagccaaattgtccctgtttgcagatgacatgattgtatatctagaaaaccccactgtctcagcccaaaatctccttaagctgataagcaacttcagcaaagtctcaggatacaaaatcaatgtacaaaaatcgcaagcattcttatacaccaatagcagacaaacagagagccaaatcatgagtgaactcccattcacaattgctttaaagagaataaaatacctaggaatccaacttacaagggacgtggaggaccttctcaaggagaactacaaaccactactcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaaaaacaaagctggaggcatcatgctacctgtcttcaaactatactacaaggctacagtaaccaaaagagcatggtactggtaccaaaacagagatatagatcaatggaacagaacagagccctcagacataacgccgcatatctacaactatctgatctttgacaaaccagagaaaaacaagcaatggggaaaggattccctatttaataaatggtgctgggaaaactggctagccatatgtagaaagctgaaactggatcccttccttataccttatacaaaaattcattcaagatggattaaagacttaaatgttagacctaaaaccataaaaaccctagaagaaaacctaggcattaccattcaggacataggcttgggcaaggacttcatgtctaaaataccaaaagcaatggcaacaaaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaacaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaaccagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactactcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaaccaaacaccgcatgttctcactcataggtgggaattgaacaatgagaacacatggacacaggaaggggaacatcacactctggggactgttgtggggtggggggaggtggggagagatagcattaggagatatacctaatgctaaatgacgagttaatgggtgcagcacaccagcatggcacatgtatacacgtgtaactaacctgcacaatgtgcacatgtaccctaaaacttaaagtataataataataaaataaaaaaagaaaaaaaaagaatacatataggataattacaattttctaaaacatcctctctgtggaaaaaagattggaagaaaaaatgtcaaaaatgttatgtgattgtccttaggctgctgaaagatgggtttcaaatattttaatttttcattctattttaaaattttcctataatgaaatgtattacttttggaatggaaaaaatgctttaaaaccgcccccccccaaaaaaaagacaaaaaacagatttctccatgtacctgatacaaaatgatcagtagtcatttgaaaaacatgactgaacacttactccgttacaatgttctggcgcattttacatgggaaataaagtattgtgttttgattaaaaaaaaaaaaaaaagcttcccatagcttttaaggttaagaccaaacttctcagcggactccttaaaggtctgtcatgatctggccttggaagcctgctgactttgccagcctcagctatcaccctgcttttccttgatcctctgttctaccacattggtcttcttgcaggccctccatgcagcctttgcacatacagttccctctgccagaaatacccttccttccactctttgcctagttaaagtctactcatccctcaggtctcagcaaaatcttcactgcctcgaggaaaccctccctgatctcctgaaaagtcagaacatccctattatgtgttctcatagcatttacctctcctttctagaatttttcacaattgtattttaacattcatttcttgataatgtacttaatgtcttactcgccaactagtctatacgttccatgggggccaggaccatgtgtggtttcgttcatcagtagggccagcacagtgcctggccatagtagagtgcttaataaatatttgttgaatgaattaaagaattaatggcaaacaaaaggaaataatttttaagatgaaactgatagacagtcaagtttccaaagtacagagatatctgatcttaaaaatccctaataaaagtattggggtgtttctctgtgtcttgaagctcctcaaagccccttctcttgaaatgattatattctgattaaatgggacaggttcataggaactgtatctatttccctccctccatatcccaacttacctgccagttttatagctcttgagtgcaccagctccatgcatcagaggcacattctgctgatgcccatccagccctgttcgccactcccttaacccagtaggcataatgcatgatccagaatcagtgtagctacagcaagaggatggcagttcctctgagctccccactaagggctaacaaggctagaggccagggatggatggcgaagtcctgggtacctggaatgcaaaaagctcagggtgacgggcaaagcctcagggctggggaggagggaaagaagcacccagttacccactctggagtcgagtcaaagaatacatacctgctgctatccacctatcccctaagccctgtctaactggagtcaggaaggaactgtcaacagattccagatgggagtcaggaagatatttttcctccagaacttggcacttctgttcatctgcagagattaatacagactagcagaaaggattgcctcctgatttatgaggactctatgacaaggtagtctgggagccaggagaggtgggattccaacccccacgtccttatgtctggagagccacatttttgtgggaggaaatgcaaagtcaattaatttttgacaccatgtaaaaaactggtatttcctgacccaacaccagggcagctagaagtttataaatgaagactctatggttcctttgtttgaaaatatgtaagttgttgttggaataaagcagctttagttctttattggaaatattctgtgttgggtaaatagaagccagaagcatgttccactgacggtatgacttcagcatgggcaggctaatgaaatgtacactgtcagcctgggctgcagaggcacatggcaagagcaagctgcacattgttgccagagtcaaaggaagcccacagagtaggtggaatcaaaacaaaacttcccaaactttgctgacgtgtgccttggacaaggtggctttgtgactgtgcctggcctgattcttctctgtgcttgacctctcagtcagcacctctaggactttgctcatgctggtcttcagcctctcctgccccactaactgggatgtcagggaccctaacctgggcaggtccccacttttcttttgctatgtttcttcatctaggaaatgagaagtttggaccagaatctagtaaccagatgttctctctggtgcctccaattcctcaccccatctgtctctcttccttctaggtgggtaaacagctaacatctcctccaggaagccttgccaccttataaattctatctggccctacactgcataatcacactcaagtcatttcatgggtgcacaagccagataggtctttggatacgggaaccatgctttctagttcttttgtctcacaccccatcttcaacatgtagtggagttttctttgtaaaactagtatgcaatccaggctgctgactgactagctgagtaatcaggtggttacttaccaaagataaaagaaaattagaagaatttttgaaagaaaagcaataaaaatgagagttaaatggcatcaagtatggttgagaacagggattctagagtcagtcagctgcaggcttaaaacccagctttactgagtactaactctgggttcttgagcaagtcactcacattccacgtgccttagttttctcatctataaaaacagggataataatagtcctaccttagggctgttaccaagtttcagtgagatcttgcatgaaaagtctgcagcatagtgcctgacatataagaaatgctccaagaaatgttaactcttttatgttcatgatggtgatgtgaacccatcccaggagggccgatctcaaggcagaatgtccacaggattggcccactgtttcttcctccctactcctaaaaaagtagatgtgatttccagaatcttgaataaatgctcggttgcctttggaatatccacacttgacttcaaggagtcaggaagtggtgatccgaggtcctcttttacttgtcctcacaatttaaggaaatgtctttaggaaacatggaaattcaagggtacatatgtggcctgttacaaatggcggacataggagaattagggaggggaaaatatagatttggggatatcagcaaactctattcttagaagtgtaataaaagcgcaaaaggacacataaggagggaattcacacagaatccagaaatccctcctcagaaacacctcaaagctgggcctctctcttgttatcaagctgctattggacatctccacctggatgtcccatgggcatttcaaactcaacttgtccaaagttgagctccttctctcctctttattcataatctcctaagcctctctttaccacccaatttgccaaattaagaaatagaaggtcatcctcagcactgccttctgtctcagcacatgactgtcaactaatccacaagctgtgtggatctgaattcctaaatagctctctaatgcacttatggcttgtcttccgccccaatttatcaactctccttggactggaacaatattcttctcaatatctcctttgctattactcagttaatttcatccccctgccatgtacaaaaccaccagagggaacactgtaaaagtcaaatctgcccaggtcaatttattgctttcaaaacacctccctgtcttcccagagcctttgcagtgaagtgaaaatacttggagagacacaagccctggccacagctaaattgtctccaacactctttcttctcatgggggcctcagatagtttacatcaacaagaggagggacagattataggtctatgagctgccctaattcattattggcatgccatgctattttactcttgtatgccacctctatccaaaaagtgctccccttcccctcctttgacctggtgaatcttactcagttttcaaattttactcaaacctcacctcctctttgtatgtcctcccttcactacagcctctcctttgcatgctaatgttccatataagaccttgaacacgctcctcgtactgtaattgtctgctcaaactgaggcccttcctgggcagggaccatattttattgatctctatctttagcactcaacacaagactgagaccaaagaaggcatttgaaaaggtttgtggaatgaactcatggcctcactaagtccctattccctataacaacaggtcagtgtctaatgagagctcccagactttggcagggatggaatctgagaaatttcaagggacttgagttctggccttggctggtactcaatgtgaatgactttttgttccgggcccaactgttccatctccactcccctgagaagaagcacaaagagaaacagggcagtggcactatcatagtcttgatcctctagtcacataattcctctgcccttttcaaatcctccctccatccctcaaggtctagtttggaccttttccatgaagaaaaaacattctcacccgagcccaggaagggattccttctcctctgaattcctgtaaagttcattgcctgggcaagtctgagacattgaggctcagaaagagaagtgacttgccatagaccccaagtctcctggggaatgtgatcaaaacagattcctgtgccagaccctagacctatgaaatcagaataaggatctgggggacatcttttgaaaagtactaaactatctcatgccagatctatgttgtgtctcctcaactggcttaccaggggctgatggcagaggctctttcttcttagttctctgtgtcctccatggcctcatatttgtgtcctccacagttatctgtgtcctccatagccccaaactacaaaggttttttcattgactaacccctgggctgcttccccatgagaaaattaaaatgaataaagaaacccaacttaaagttagtctcagggcaccaaggaaaagctggccttggcagtggcagccttcctcggatgctgctttctgtctgattttctaagtgccaaggttatccttaaccaaaattattccacattggaagattatgtttcttaggatgataaagggtcatttacttggaccccctcagacatttttctcaactctgttttgggaagaaaaatgaacattccaaaacaaaacaaacaaatgaacgcaccaatgcatgaatacctggacatacactgagatcacagtcattttttttttttttgagacaaggtctcgctgtaaccgtagggtgcaggggcgcaatcgcggctcactgcagcctcaaactccccagagctcaagcgattctcatgcctcagcctcctgagtagctggaactacaggcatgtgccaacatgcctggctaatttttgtatttttttgtagagactggattttgccatgtttcccagtcgtgtctctaacttctaagctcacgtgatcctcccaccttggcctctcaaagtgctggaattacaggcatgagccacggcgcccggcttgaggccacagttttatactttgttgatttctatccctagcctgggcaatgattccagataatcaagaagatgaaccacctcacgaaggttcgttacagtcactaggctgagctcattaaggcaggaaggtagcctcagatattgtggtaactcttctgacaaggagggtgacaaaataggctttctgtttgagcctcagtttctcagaaattcctactaagccccttccccaggattctgatcagttaaggttctacttggctgagaaggccagagttatctagacctcaggcctaggtccccactgactccactgaccctacctctgggaagaaaagtggcctacatccttgtcacccatcagaaaatagacacaggatcagccccagcctgaccccaaagattctttctcatactaaaaagccattgccctgtccctgggcctttgggcacagttggataggcaggaaccctggttagaagaagaaagggagctcactcattcacttttgtcactagtcatcccatgcacagagacgtggccagcaagtcctctctagagtccattaacactcgtgtgcatccagagcttctctggtcacccctctgggagtagaggggtgaccaggcaagctcccctgagaaggatgcctaggagttgaatatactcaggcaagacaattacctcaagtctccaaaaacgtacaagatgtttcctgggacgccagagggttagtgtgaggaaggttatgttcggttgttaatttccaagggcaagtgcagagtgagaaacaagagataagacctgaaatgtcaggcaccaggtagacactacagtggaggcaggattgaaaaacaagggtgtgggcaaagtgagaaagcccaattacattagggatggcagaagtgggagtaggggtaggaaattgaggcataactataggtctcaaggacatgaacagattattctgagttaaagctccaggtcctggatggatactaaggttttctagtggggcctcaacaagaccttgccctcagggagtctgaagtgtagcagggcctttctgtacttaaagaagaaactgcagtacctcccagccttgggtcgccaaaggccaccaaattgttgaagctagaaaaagtcattggcatgatagtaggccctcctctgtgtaggaaggtgtcactagtcaaaacttctgcattggttttgagttgtttttgctacatgtgagatggactggccctgacttgccacattctctcatggagtttgcagtgtagctaaagaaatatatttgccaaatcaggctcacttcattatcaagggtttcctgactgatgcactatgttcctaaaaactgatataacttgaccgccaatccctgaaggcacctaaggaaagaaacattccagtttcaccctggcctatgtagcttgataagcactaagctctacagttttctgggctttattcttgttagctgaaatcagtggaggcccaagggcccatgaatcatatgaactttctgactttctgataccttttgaatctctacaattccatgaaaaggacaataaacccttataatcctgggggaaggaaggggagccattccatcgtctttcactctgggatatttttaacaagaataagaactactgagctaggcttggtggctcacacctgtaatccaagctactcaggaagctgagggaggaggatcgcttgagccaaggagttaaaggctgcagtgagctatgattgcatcactgtactccagctctggacagcagagcaagaccccatctctagaaataaatacataaataaagaatttccatccaatggagcgttattcttcatgcaaggcagtatgtagaagtgctttacctacattacctgaactaattcttacaacagccctagggcagaggtgctagaagtaggtccacttcacagaaaggtttaatgacttgcctaaggtcacacagctaatctgaggcagaacccagatttaaactcaggtctattgaatcttaaagcccatgctcttaatcactgcacctgtgtttctcaaagcaggatttcggtaaacatgagcagattcccaggccccaccccagatctgttgactcagaatcctgaaaggtggggcctgggaatccacatgtttaacaccgcaccaggggctcttctacattcagaagttttagggccctggtgacactatatggcctcctgcgtttgccatacagtacaggcaagaatgggtaaagcttccatgccaggcctgacatttctcagcacttttcccagcaaatctgccacctgggaatggtcactgaaaatcttttagcaggaccaggacatccgagccccttcatctagaacagggactcttagcccttatgggatcatatacttctttgggaatttgttgaaagctctgggtctctcctctttcccacacaggcacatacacacagaggcccacactactttggtggcctccactgaaaatatacacacataaccctttgcatatattttcagggagtatatatatcttctgaggccccttcatgagccactctgcagctcaaggaccccacatcacagaggcctctgacctagaaatgtgaacacagactaggtccagtgggcatgttgtttttaaatcctttctatgttagagatgcatactggagtattacagatgatgtgatctgttgtctgagatttgtttgcaaatacacccagctatgaggggatgacaggcatggggagcagcaagatagctccagcaagaatgcccataagttgctctttgttgaagctgggagatgggtacatgggaattcattccactggtctctctactgtttgtgtgtgcttagcaatgtccataatcaaaagttatataaaaaaattagggtgagtgacttggtatgtgaaatgtgaattatatctctgtcaaaagacaaaattgcaacaaatacagtttaaagatatgaattggctttaattgtgattctagaatctagcagcacctcattctataaaatagaataagtgttcacatgaactgagcaggggagtttggttttatagacagaaaagggccgaggagagcagaaacagagaacaaaaagcaaattccaaagttactttccttgtaaaggttaaagcagaggggacttatcatgctggctaaaactggcttgtggtatttggctattctctctcactcttttgatttctcagaagatcagataaacaacttagtttcagcttggtgaaatgcaaccttggcatgagtgactgttttggtttggtctgttgggtctagcgcaggagctcagtccaaatcaatgggctcctataaattttatttaatatcttcataagactgcttttaaaaacaattaacctccttatctgatccacctaaatctgccagtggacacatgtactaaaggccaagagagaactatttaatttcctgcttgctgttctttaaagtcataacagttaatcaaaacctcttgatcttgctaagatggcagaaccacaccaagcaggcctcattagggaattgagaagaccagttgctgtatatgaaggactacatgtacaaggactactctgctaatagcacaataatgataatcatcatttacattccaaggtcagagcactttatgaagagacatgaaactgagagttaccaataccctctccagaagcaaaaaaaaaaaaaaaaaaaatagcagagatcccattaacaggcctaattccctgctgtttaaagcttggaataaaaaagatgtttcctgagtggatttcaaagttcttaaagctagcaatttgtgaggtttcttagcaaggtctcataataatcaaacaggttttctatgcaggaggatatgggggtggagggtgaagagtgacatccctacctgtgtgcaaacatttgcaaagaggctccctcctctcccttcttgtcctgaaatgctgaagggaccttccccccataagctccccatacaaaaaaaaaaaaaaactgtggttcttgcttgggaggtaaataaacctatagccatctgcagagttgacttaaccacatctccatttttttatagcatatgttcctctaccactgcaacttctttataaaatggggatgacaatggtccctgcctcagagggttgatgtgaggtttaaatgagattttccgggtgaatacctcagaatgaggcctgggcacaccacaaactctcaataaatgttagttattcttattcatgttgttgttttctttggctcactgcagtacaagccaagccattccttagatatagcagagtgatagccaatagcatccatctggccccttcctctctagtggacttacataggaccaggctgctaaaactatccagggggcagtaggtagggaggaggaagtagaagggaggtggagataagaagacagtggagtctccgctgggcttagaaagacctagaagtctgctctgtccggtcgcacacactggtgtaggttgcccatcctctttcttttctttaatctgcgttagtgatatctccatgccttcttttttccctttatgactgtccttgatgtgcatttccccaaatttcatctggatgtgtgctaggccagaaggaaatgaccacagagtgtgatacctgcctctaatcttcactcagggctggccatcaatttgccactcccactagtgtgatgatgttacccctaattgagtgcactgaatcagtgcttcaccattcaaatggtaattgttccctctctcagattctccaaatggaagtcctactttagcaccatgttagcagcaaatggagaagtggtagccatccttcccaaaacctactccttctctattcccttgtttcaattagttttgtttacaataactttggttatttctttaaacaatttttctatgcagaaggccatgaaggcattttaaccagcccaaccctctaaaggatgctctctgaagtccagccagtctacaacactgtgaggggagccctgtaatctgctcttcagaatataccctgatccttattttgaaattctgtaagtggtacttaataaggatgccagctgagtagcaccaaacaaataagaccaaaagaaacctccacaactcctggtaaataagcaacacagaacatctgattttacctaaatcgaatcttgagtgtctcttggatgaaatttttaaaataaaaaataaaagtgaatccttatttagtggatataacaaaaaccataagaagagagtaaccagcatgctcagaacaagtccaactacccccacaaaacagactccactgccattggtcacagtcacattcctctgggaccctggagactacatatgcaaagagccacaggttttgggggcctggtgagcaagggtcaacagatgacaaattgtgtggggcccagagcccaaagagccagttaatatctctccaacaatggcccttctggaggacactggccccatttttctcttggtcccattgttctgcccaggacccagggtttcaagggcaggctccagctgcctttgatgacaagactaggttgtgagaaaccacagatgggaaatggtggcatatgcactctgggtcacacttacagaggccattagagcagggacattcagcacccagccatctggccactgcaggaggagagcaggaccctgccttttgaacaactctccaaggagcccctctgtcaccaacttatcactgtgcagtcctgtgatcctccggatctctctttttttttttttttatactttaagttttagggtacatgtgcacaacgtgcaggtttgttacatatgtatacatgtgccatgttggtgtgctgcacccattaactcgtcatttaacattaggtatatctcctaatgctatccctccccctttccccctccccccaccccacaacaggccccagtgtgtgatgttccccttcctgtgtccatgtgttctcattgttcaattcccaccacttttttttttttttttttgagacggagtctcgctctgtcgcccagcacaacaggccccggtgtgtgatgtttcccttcctgtgtccatgtgttct[137 bp omitted]tgcctcagcctcccgagtagctgggactacaggcacccgccac[138 bp omitted]cccggcctgaatctctttttatatcactgcctctccatccccagcctggtgccagatgccaaggcaatagccacgcttgtggggccaaaccaggaacccatgtgttaacaaagcagctggttcttccatgcaatctggatccagctgtaaatatggcagtcatgaggaagggcacagagctggtgaagaaatgcagcaagtccacttttccttaggcatgtggaaatcatatgctttgctgagtgctgtgacacttttttttcttttgagacagggtatcactctgtcacccagactggagtgcagatctcagctcaccacaacctccacctcccaggctcaagcgattctcctgcctcagcctaacgagtagcctgggattacaggcttgtgccactatcgcccggccaattttttgtatttttagtagagatggggtttcaccatgttagccaggctggtcttaaactcctgacctcaaataatccacccccctcagcctcccaaaatgctgggattacaggagtgagccaccgcacctagcctgctgtgatgaatttttaaaacaattttagattgggttcactctgattgccaaatctctactgctaactgctgtgcacacagggagatcacaccggtttttgttatgaatgtaagtcaggaatggattgaaaagtcatagatgtgctgtaataaactctcagactggaatacaaaaatattttaattcccttggagccagacctgaacctcaatgaactagaaacttcttgaccagtgacttcaaataaccagcaactttctcctggcttgcctcaaccccttataggaaaatgagctatctctttttatatcacaagagagtggaaaaaaaattgaagtggagaatattttgagcacatcacattcagcccagtctctatttctctatctgtggcacttggtcatttgttgtcaaatttgagtgggcaccagaatcatctggagtgcttgcttaacaaaaagagtctcaagctcaccttcagtcattcaactggaacatcaactaatatccagaaaatacctgctatatgccaggcaccatggtaggtaccagggatccaacactgaagaagaaagagtccctgtccacaagaagcttacaatttagtgaaaaaaacaggcaagaaagaaagaaggtaatagcaggcatctatgagtgctatgaagtagacaaaacatggaggtgataaggagagactagggtggggttatggttttagatagggtgaccaggacagacttctttgaggaggtgacattctgctgaggcctgaatggatagaaggagccagccatggaaaaggcattatatcagaaggacgagcaagtgcagagatcttgctgtgataaaaatgtgtttggtccattcaagtgcagaaggacagacagggccaggtgcagtgactcacacctgtaatcttagcactttgggaggccgaggcggaaggatcacttgatcccaagagtttgacaccagcctgggcaacaaagtgagaactcatctccaaaaaatatgagcaaaattaaccgggcatggcggagcatgcttctagtcccttctacttggtagactgaggtgggaggatcgcttgagcccagggagggttccagcctggacaacagagtgacagagggagaccctctctaaaaaagtaaataaaaaaataaaaataaaaaacacagaaagaaagccgacagaggtccaagaagctgaatattgaacaattgccctcctcctccaggtgattctgagatagaggcccagttgaaaatccctagaatagacagtcattcagaaccctgaccctgaggcttgaaacatcatcccaatcagcaaaactgtgctgtgctatttaacgaaaaggaaaagatttcccagaattgtgactggtacacagtagtatctgatgaatgaatggcagccagcaccaaaaatctcctgatgctcgatgagctcattttcaaagaaacagaatttttctcaaacaaagcttcaaaagaagtgagataaaaaaactttctcaaaagccaaaattgacaaatgggatgtaactaaactaaagagttactgcacagcaaaagaaactaccatcggagtgaacaggcaacctacaaaacgggagaaaatttttacaatctacccatctgacaaagggccaatatccagaatctacaaagaacttaaacaaatttacaagaaaaaatcaaacaaccccatcaaaaagtgggcaaaggatatgaagagacacttctcaaaagaagacatttatgcagccaacagacacatgaaaaaatgctcatcatcactggccatcagataaatacaaatcaaaaccacaatgagataccatctcacaccagttagaatggtgatcattaaaaagtcaggaaacaacaggtactggaaaggatgtggagaaataggaacagttttgcactgttggtgggactgtaaactagttcaaccattgtggaagacagtgtggcgattcctcaaggatctagagctagaaacaccatttgacccagccatcccattactgggtatatacccaaaggattataaatcatgctgctataaagacacatgcacacgtatgtttattgcagcactattcacaatagcaaagacttggaaccaacccaaatgtccaacaattatagactggattaagaaaatgtggcacacatacacaagaaatactatgcagccataaaaaaggatgagttcatgtcctttgtagggacgtggatgaagctggaaaccatcattctgagcaaactatcgcaaggacagaaaaccaaacaccgcatgttctcactcataggtgggaattgaacaatgagaacacttggacacaggatggggaacatcacccactggggtctgttgtggggtggggggaggggggagggatagcattaggagatatgcctaatgtaaatgacgagttaatgggtgcagcacaccaacacggcacgtgtatacatatgtaaccaacctgcacgttgtgcacatgtaccctagaacttaaagtataataaaaaataaaaaaataaaaatctgtttcttcttgcccactagttacccaagaaagcattgtgagaatctcccactttctgagcagccatgtccagggtagtcactgcattctgaggtaggagctcagcctcactgtggagccctgtgggcttacaagaataagaactgattgaatcagctgagctcactactgggatcaaccagctgtggccacagccaactgggttccttggaaggcccacatcagaatttgttgatgccaggtgccacctacaggctgctgggagcctggcctattcactcaggaatcccggccagggttgctatggggcctgcccaagcctcctggaacctctgcatgatcccattgagtaatgagggtctgggtcatgttttggggcctctcccctgtcccttcatgcatctctcccaacacctcttacctcaggcagccagaaccacgtggggcaactttaacctggaccagtggtggtacctggtgccacacctagacaggtttataaaatctacactccagatctcttcctctccctcctgcttcctttgccaaacgaagccttcctgtggaggcttctacttctgggaagatggaataaatgtactacttttccccattcttcccactaagtacaaataagaatgctagactgtatatacattacgtacattatatactttttaaaagagaaagaaaaagaagaagattcaaaggtggagacaggggccagacatgtggggtcacacctgtaatcctagcattttgggaggccaaggcaggagaaccccttgagcccacgagttccagaccagcctgagaaacaaagggagactctgtctccatacacagataaaataaaataaaataatgaaataaaataaaataaaacagagacagaaagcccagagaggtccaagaagctgcattttcaacaagtgccctcctcctccaggtgattctgagatacaggccaggttgaaaatccctagaatagacagtcattcagaaccctgatcctgaggcttgaaacatcaccccaatcagcaaacctgtgctaagtgctatttgctgaaaagggaaagatttcccagaattatgactggtacacagtaatatctgatgaatgaatggcagccagcaccaaaaatctcctgatgcagaatcccatcaagcttattcaaaatgtatatgaagagccagcggaacttatgaatagacaaaacaatttcgataaagaacaaactgggaggaatcattctatctgatttcaggacttgctacatagctacagtaatcaatacaatgtggtattagcaggggggtggacacattgattaatgaataaaatagagaagccagaactagacccacacaaatatgcccaatcgattgttgacaaaggtgcaaaagaaatttaatgtagaaaagatggccttttcaacaaatggcattggaacaaatgggcatcaataggccaaaaaagataaaataacgcaaaatggatgatggatttaaatataacatgtaaaactagaaggcttttagaaaaaaaacaggaggaaattttcaggatccaggtgtaggcaaaagttctcagatgtgacaccaaaagcacaatccatgaaaggaaaaattgataagttggactttatcaaaataaaacctttttctctgtgaaagaccctgttaagaggatgaaaagactaggagaaaatatccaataaaggactagtatctagaatatataaagaattctcaaacttaacagtagaaaaacaatccaattagaaaatgaccaaatgacacgaacatatacacatatacagatggcaaactagtatatgaaaatgagttcaatattgctagacattagggaaataaaaaataaaaccacaatgagatacctatcagaaaggttaaaatgaaaaaaaaatagtgacaacacaaatgctggtgaggatttggagaaactggatcattcatacattgctggtgggggtgacaaatgatacagccactctggaaaacatcttggccatttgtgctttctagggggaggggagagtttaagggaatttttattatacaagtagttcctcacagtgatttgaaaaagtatgagaccatatgaagaaagtttagtaatttcagatttactttgtaaaagcatgctgacaaatattaaatgttatacttgcaacatttatatatatataaacatctatatatctgtagagatatatacatatctctacatacatagagatacatagagatgtttatatatatataaacatctatatatctgtagagatagggtctc[132 bp omitted]aatatgaaattgaaacacaaaacatccaatgttaaacactgatctcccctgcctgacttggatttagatattgagtattttgtattttatagaaaggaactttcaaagttttgttaatgtatgtacttatagtatatatcattattcctcaccaaaattgtcatgaaatttaaaagactggtattaaaagttttttttttttttgaatattttaaaaccagtttggattaaccttcagattttcagggcatgatcgatatgcaaatagagaacccaagaatgggttttaggacatttagggtaagtttgtttacagttgtgacaaaaataccttcaacttttagatatgaaaaaaaaataccctaagcaaacataaaagtagttgggtcaagttactttttaatacaaataatacattgtgtcaatcaatttttaaatcaaattctcaaaagcatttagaaaacatttgtattttataattgtcaaacaatgcatttatgtagtggaagaagatacaagtaaagcttataaaatcaaaaactctcaaacttttccaatttccaggataagaaatttgcaaattaagaaattactgatttgttggaaaatatgccttagttttactctcaactgcttgacatacaattaactgcttgacataccattaactgctttacatacattaactgcttgacatacaatttaatacttaaaaagactgtatctaagctatttaataatattcatagagtattacttctctggacagacgtgtttcatacaacagttttcaactgttaagaggaattcacttgataattttaatcataatttaagattgattaaggaattaatttattcagtaatttagatgcaataaacaccaataaaaggaataatccagtaattgctcattgtgcaattctgcccattaatactgagctgagaatttgatagatatttcactcagttgaattacgtgtttctatgtgagatattgatcaacaaaaaaaataggtacacaatgttaagctttttcctttttctttttttgttttaacagcaggtcaatgatttagggagttggttagtacaatctacgaacatagcagaaaagtacaaaatgtcacataacaccaatgccagtacttgtcccattatggttttaaataagggtattattcatttttatgttgttttcttctttaaaacgtaaaacaaaaccattaacttgaatttgaggtatacacacaatacatacacaattgtacgcaaaatactttttttctttttttttctttttttaattattatactttaagttctggggtacatgtgcagaacgtgcagttttgttacataggtatacatgtgccatggtggtttgctgcacccatcaacccgtcacctacattaggtatttctcctaacgctgtccctcccctagccccccaacccccaagaggccctggtgtgtgatgttcccctccctgtgtccatgtgttctcaatgttcaactcccacttatgagtgagaacatgtggtgtttggttttctgttcctgtgttactctgctgagaatgatggtttccagcttcatccacgtccctacaaaggacatgaactcatcatttttatggctgcatagcattccatggtgtgtatgtgccacgttttctttatccaatctatcactgatggacatttcggttggttccaagtctttgctattgtgaatagtgccacaataaacatacgtgtgcatatgtctttacagtagcatgatttataatcctttgggtatatacccagtaatgggatggcttgatcagatggtatttctagttctagatccttgaggaatcgccacactgtcttccacaatggttgaactaatttacagtcccaccaacagtgtaaaactgttcctatttctccacatcctctccagcatctgttgttccctgactttttaatgataaccattctaactggcgtgagatggtatctcattgtagttttgatttgcatttctctaatgaccagtgataatgagcaaaatacttttcataagtagcattacattttaaaatattggaaatgctatctgtactgatttgcattttgacttaatagaacaagaagagaacaacattcaactaaagaaggctatactgataataaagctcttaaaattcaaaatgtcttcctctccctttgtatttaccacaggctacacaatgtcctgagaggattcattatgagaaaaatgtcaatcacagctttaataacttacttttgagggaactaatgagaaagcaaattggaaggtgagacttatctgctttcaagtaagtagtcttaatttttcttcttatagaaaaagcttaaataggtttattattaaatatatttaaactattaatttttgcagctttcataaaggtcagcacttcgtatataccaagtctatgagaagacgtcagcaaaaatcatttgatcttaaacggtgacatcatccgttcaaatcctacctttaatagaagttagcttcaaaaaactgggagatttccgctacagtcatgcattctttaacatcttgttaattagcaaaaatcagcaatccagtttttcttaagtcctcatgtgctaacattttacagtgttcttctctagttacagaaatcctgtctgtaccgtccacacaactattacaaactccgtgttagtatagtaaacattccagaaagaaagaagagactcttgaccaccaatattccacagtaagaaacgtgtattattaatcactgtctcctttacattacttcctgttgtacgggagttatgtacaacttcactcacagaaaatttgaaaagaatgatagttttccctgcgttatccagtcccacgataataactttgtgctcctggtgactgaacagtctccatgtttggtgaattcccactctcgggcagcaaacccccctccaatccccctggactgcctgaccgcccctgtctcaagctgagtgggaggagagagccgcaccagagtctccgcctctgctgctggggctcctgctctcctggctcaaggatatagccatcttgttgtcagccatgagcctcgagggccaccatcctccccaaagtgctctgggcagctccacgtaggccatttctttaaaaagttcaacattcttcctaaatcatacaactactatatgatccagcaattacacttcttggacatctctcccagaaaaatgaaaacttatgttcacatacaagcctgcacactaatgttcatagcagctttattcataatagctcagaatgagacaagagaaaaaggtctggaggcaggcaacctaaggccgtttcaccctgaattcctataacaaaattgaaaggaaagccctaactttccatacctaagtaaaaaaggaccagaggctactccttttgcaaacccccaccggcagatgggaaattgaaagtacctctgattgtttgctttttgcggccaagtctttgtttgcatagaagtgcaactttgtaacttctctttagcctctgattggttgctttccacaaccaatgagatgtttgcataagagtgtgaccttcgtaacttcacttcagcctctgattggttggggaaagctttctgcaaccaatcagactgattgtgggccaccacttcatttacatgaggtaaacaccaagtggccaatgagaaacctctagagggtatttggccctgagaagattctatatctggggcccttga[134 bp omitted]gcaacctctgcctcccaggttcaagcgattctcctgcctcagcctcccaagtagcagcgattacaggcacctgccaccatgcccagccaattttcgtgttttttgttttgttttttgttttttatttttagtagagattgggttttaccatgttggccaggctggtctcgaactcctgacctcaggtgatccacccgcctccgcctcccaaagtgctgggtgggattataggcgtgagccacggtgtccggccctgtggagtgtactttcattttcaataaatctctgctttcattgcttcattctttccttgttttgctgtgtgttttgtccaattttttgttcaaaatgccaaaaacctggacaacttgcagtcgagaccctctaccggtaacaaaaactgaaatcagcccagatggtctcaaacaggtgaatggttaagcaaactgacacatccataccatagactacccactactcagcaatttaaaaataaaatgaaatgtatggatacatgcaacaacctggatgaatttccatggagttatgttgtgtggaaaaggccaatcccaaaaggttacatactgtatggttctatttttgtaacattcttgaaatgacaaaattatagaaattgatatacacctactatatacccacaaaaattaaaaattaaaaagatatacagaaatggagaacagtagttggcagacgttaaggaggggattggtgtgggaggaaagtaggtgtagttataaaagggcagcatgagagatccttgtagtgatgggatgttctgcatcttgattgtattaacatcaatatcctacttatcatagtgtactatagttttgcatgattttatcattggggaaaactgagtaaagaatacgtggaacctttccgtattatttctgacaactgcatgtgaatctatctcaaaataaaagtttaatttaaaaagaaatggcctttctgtttatcctcttctcttggactctgctatgataattcttgctgaggtgtcagtgggtagtaaaggcactgatattatcccacctctcacttacatctcaacaggggctttctggaaattgtagaaggccaacattttgtagaaaaaactacctttaaattaaaatcaagataccttgaggcctggtcttaacatgctttgcgacactgggcaaactgcttagcctctctgagattctatttcatctgtaaataaaataaaataaaaaatctttgagggttaagtgaaaacacttggtaaatcttggtaaattataaaacactacacaaaaggaaggtcttcttccctctcttcctcctttcctgtcctcattaattcagctcaaggaagcgatcgtgtcctaggtcttcttgtatccctacggcttagcttaagtctgtgctctaggaggtgtttcataaatgatggttaatgctgataatggcagaatgcttaaagcaagggtttggctctaacagattaaaggtggttcagctcctagtggtgagaatttgaagagcccttcatagcatcccaagtagacagtgccctgccctgggcaaaactttactcacagacatcaagggaaggaaagtcagagcccatggaactggccagctgccattttggggaaccagagaggtaatggctagaagcaaaaagcttctcactttgaccaagaactttcctacccattatcttctttgctcctcaccatcctcctgaggcaggcatagcatagatcaaccccattctacaatttgcaaacactgaagctaaacaggactgtgacttgctcaaggttgacacagcgaatgaatcagtaacacagctggggacagactcgtgggccagatattttccacagcacagatggttaccaaatggaaaagctaagacaaagaaaatgcaggccttccccaccccaactcagagcttctccccagagaattgtggctaggcttcccagccctctccacacaatctcccatctaaagaagctgctgttgctgcaggcctggcagtgttgggatgctgcctgagacggcttccctccttccaagctctgagcttacagtgacctatttaaaggcagagaaatcagtctggggttagggcctctcccgagcaggcagtgcctctcacagatggctctccagagccttcccaggcacttcttccaacttctcctcggtgatgacagctgggggtggggtgggcagggaagctcacttctcatctgtccctgaaagcccagaatgtcctaagaggcttcccagggtctaaagagaaccaagttagggcctccctggaaggcaggctaaggaaaggtaacagctcccctccctgtgccctggccagggtctggatgcttttcccaggggccctatctctccactgctgcctccaccgaagctccaggatgaaactgaaagggaaatgtgaaaatgcaaatgctccttgggaggggaagtgtcagaagccatttgcttggattagttcatccatttgtaggttgccaacttggaaagcagagaggaccgctgaggccaggacgagacgaatggcagaggagcagggtttgaggttgcagtgagggctcctgagcatccagcctttcagtcagcaagccattcagcaatcccttactgagtgcctgccctgtgtctggccctgtgctgtgtcccaggggccactgtttctgccctcctattgccctcagtctagaatgaagggacagaactcccagaggagacatgaggcaagaagtatgaagacaagagcatatgctcaggccagtctgttttggcttccagtcatcttgtgggaccttcagcaactggcctaaccattcatttgttcgtgcattcattcacattaaccattccttctctgaataagtactcatggagtgcttactatgtgctgggcactggagatacagcggtgcccttctggagcttacagcctaatgggggaaaagacaaaggaagggagtggggaggaggtggcgctcctttagatagggtgttaaaagagacctctcattaccatgaagtcacactttaagagttaccccttaaagatccacagatgctttccagcgagcgctgccaaacctgaaatcgaacagcatcctgaagaaactgccaacattttgcagacatacaagactcaaaaatgggtccctagcacctcgtaaaaaccttcccccttacaaggcctctcaccagcatacagggaggtttgagtagggaaggagaaagggcgttggaatgacgctcttgaacatccagctgttcggtcagtgtgtcatttagtactggcttactccctataggtccaaaaatttcctccctgtcttaaaggcacagtaacttaggaccagtcagctttactttccttcattcatgtgttcaagaagaatctactaaacatccacaaagagctgacacttctctggagtctggagattcaggggtgaactagatagccatggcctctctgggagtttacagtctagtccataggagagacagagattaattaattgcatgaataattaataacaattgtgctaagtgctttaaaagagactataatagggagaacctcattcaatggaggagtcagcgaaggtgtacctgaggaggtgacttctgcagctgaggcctgagggataagcgggattaggccaggtgaggaggtaggagaggaggaagtgttgtcttacagacatgtggaggaatgtggaatcccagaagccagatagtgtggtactttgaaagaacacacaggttgaggctgagtgaggtaggaagagaggctcaagatgagttctgggaaataggcaaggagggaccagacaggcagagcctcacatgccttgataaggatttgggtttcatcataagaaatttggggagccactgaagggctttgggcaagaggccaaatcaagtttgcactgaggggagggggggcagccatagtcaaagtgcagagacagctggaaggctgccacagtcatccaggtgggagatgatgacaggagctttgattcgtgtggcctggtaaaaatggagagcaatggacagagtccagacatatttaggaaacggaatcaacaggacattgtgatggattgcctatggagcttcagtgaagggaggcttcattcccattctctagagtggggctgaggacacataggagaaaatcttcaaaaccaagggcttggtaaagacttggatggatgtcacgggca[142 bp omitted]ctactaaaaatacaaaaagttagctgggtgtggtgacatgcacagtagtcccagctactcgggaggctgaggcaggagaatcgcttgaacctgggaggtggaggttgtagtgagctgagatcatgccactgcactccagcctgggcgactgggcaacagagtgagactccgtaaaaaaagaaaaaaaaaaaagctgacctccaaaggttgcatatgatatgattccatttatataacattcttgaagtgataaaattgtagagatggagaacagattagtggttatcagataagtggtattcctaccaggtgaagggaattaagtgaatgtgatcacgccactgcactccagcctgggtaaaagagtgagactctgtctcaaagaaaaaaaaaaaaaaagaggaaaataaaagaaagcattcaataaaatgaagctactattaaaaccaggtactgccccctgttttcaggaagcctccaattcagccctgtggacagggaaataagggaacctgtgcctagggtgacattcatgagtccgggagactcatattgtattaaatagaggaggtgggaaaagaacggagagggtaagggaaaacatgaggacattttaaagaaaaaactaggagtacttaggcaaattagaagttgaggttacagaaggaataccttaaaagtctttgaaagacaagcctgcatttattaatgtgttcacaggttattaactctttaactgaaagtctgaggagtaaatgtcagggaaacttcagcattgggagcccccttaatggcatgtcagtggaaataactgtgtcctactagggacatgttacttctttaataattctctcctgaccaaaactcatcttttaaaaaaataggctatttttagatatatagaatagttttaggtatatagtaatatataggaataatacatataactatagaatagtttccccatagattttctgtcctttagcttaaggccagactccctttacaatcctaatcttacctaagagtagattttcatagggggagactacgacatctctcaggtgacagaagaagggaacagggaatatgggtaagaagagggagaagtcttctctttcctgtgtaagtctgccaggcctgtgtggacaacttatcatgtcagggtgtatccttcacccttcttattcattgctgagagctcagttcagtaggacagagcaagcaggcccatgatgatgatgaggaggaggaagagaaagatgacatgagctaccatgtttcaggtacctaccatgtgccagaaactatgcatgcattttctctaattttcacaacaaatcttacaaagaaggtagtactgttagcaccttttaaaagatgtaaaaacagcttcagataggtcaaaaagtttggcagagccgggttaagaacccaggtctagtcttgtcccagatgtccactttgaaggagaccataatagggaggacttcatctgatggaagagtcaggaaaggccttaccgaagaagtgtccaaaggcctcttctccagacaccctctccttccttaagagtcagccagcacttgctcacacatggctgttaggctcccatttccctggtgacaggcagtaagatgaagatcagataaagagccagaggatgatcagaaccccaatttggtcacgtgtttggattcaaatcttctgttccatcaagttgggcaccccccaccccacccaaaaaccgaggaggcctaaaatctgcacagtgtaatttcagagtgcctacccctcctctcatttgctgtacctgaacttgcagccttcctttagcctagccctcttttctcccatgtggggtagggacccactaggtcctctaagctgtcaacatgcaaacctctccaggagaggccatggtggcctcatagtgaattccaagtgaatcccaagtaggatggaagcttctgatggatgtggagataaagagagattaatgagttagaagggagaaagaccatcatagaatgaggggagaactgaagaatgatgttggggaaggagtgaaattgaatatactaactttgtgaatgtttcagaagagaaaaccagtgtctcctaaggtagccaaacaggcttaaagtcttgatgcgaagaaaaccaataaatgaaacctggcactgaaaaaatgacaagaaagaagaacattaagttaattgtagttgactctgggttatgggaatatggatatatgtacatgtatatacatatatatgtgtgtgtgtgtgtacacacattactacaatatagtacagtaatatgtacataaagaaagagatgcgttccctggcatccaggagctgccctggtaccatcagctaggtcttggtgttggtggtagctgtccttgcacttacagctggaccatggtgatctcctattgagcatgaacaatctcacagaacggcaacatcagacaaggccactctgtgacaacgatcaacgaaggcaaaaaccagaccacaccataattatgtcttaacaaagactaaacatgaacattgcccaagccacataaagaatcaaatgtccccctctcctggctaataagagtgattgctgcttcttcgttgcttctttgccaattgcagctttagcctcactagcttgccctctctctggatactctctaaataagaatacctagtcacagaattggccccgcttcctgatagcatccaatctagagccaacaccagcttccttaaatcctccaaaaatcacaggacacaagcccaagtcctataagtgctttctaacactctcttcttgagatggccatggtttcccatagtgtgtattattccttgctgctggagagtatggagtatgtgtgcttgatagacagatagatagattagatagatagagagatagatagataggtgaatagatagatgtatttcacacatgcatatttttttttctacatgatttggtctcagctttaaactcttcatttggcatgaaaatggagccttggtttgacttctgaaaaacagaatgaagtcattagcaaagacaagggatcaacccaggttcccaccaatggtggattggataaagaaaatgtggtacatgtacactatggaatactgtgcggccataaaaataatgaaatcctgtcctttgcagcaacatggatggagctgaagaccgttatcctaagcaaaccaacacagaaatagaaaaccaaataccacatattctcacttacaagtgggagctaagcattgggtacacatggatataaagatgggaacaacggacactggggaataaaaggagcggggaagggaggtgggtaagggttgaaaaactacatattgggtactatgctcactatctgggtggcaggttcaattgtactccaaacctcagcatcttacaatatacctttgtaacaaacctgcgcatgtaccccttgaatctaaaataaaagttgaaaaaaaaaaaacagagtgaagtctcattaattgaaagagccgtaactcacaatacttgatgagtactataacaggcagctgaggtttacctttgccccaactataaaaaatgaacagcaagctatgaaaattaatcatctgaataaaagtgactgtgagacagttcagctagtttaaaagtagaatcaatttgcatgctaattatgtgctaattacgttattcattaacaaaggtcaagggaacctctacttagttacatcctgttaggtgttagttgaggttactgttttacttgaaaacaaaaagtctataaatcagacttcttattaaatcagaccccttatttcagggggcctttatctactaaattattttgaaacagcaaggccagctacccatcacataccatcaggggtccccggttgattcatggagcaaagtcacattgagtgaatacagttattccggccatttcagcaaagtaatttgccatcttgtctcagtctatttgtgctgctataacaaaatacttgagacctggtaatttataaagaacagaaatgtattttctcacagttctggaggctggtaagtccaagatcatgacaccagcgtggtgtctggtaagggcatcttcccatggtgtcctcacaatgtggaaaaggcaaacgccgtgtcctcacatggcagaagggtaaaaggggcaaaaggcagctagggctctcccttaaagctttctttttttatttttaaagatggggtctcaccttatcacccaggctggagtgtggcgtgatcatagctcactgcatcctgggctcaagcaatcctcataactcagccctcccaagtagctggaactataggcatgagacaccatgtacggctaatttgttttattttattttttgtagaaatggtgtctcactatgttgcccaggctggtcttgaatttctggcctcaagtgatcctcctgcctcatactcccaaagcactagaattagaggtgtgagccaccacacccacctagacccttcaacatcttttataacgtccctaatcccattcacctcccaaagaccccacctcataatattatcacattggggattaagtttcaatgcataaattttgggggacacattcagaccattgcacacatctcttcaccattcagggcatttcgggggcgcattcttcactcctccctagtccatggtttctcaactttggcattattattttggtgcagataattctttgttgtggaggatggcttttctgccaattacagcttcagcctcactagcttgccctctctctagataagatttattgaaatacctagtcatagaattgaccctgcttcctgatagcatccaatctacagcaaagcctagtttccctaaaccctcccaaaatcacagaacacaagatgtatattttactgtactatattatattcatatatacacacacatttacatatacgtttgtatatatatacatccatattcccataaccctgagtcaattacagttaacttaatgttcttcttttttcatctttttttcagtgccgggttttcatttatctaaaggtctgtccccacaacattaatattcattacaggatacttagcagcatccctagccctctacccattagatactagtagcacaaccctctcctagtcacaataattaaaatagcccccagattttgccaaatgcccctcgggtgcaaaataacccagttgagaatcactgttagaatcccccagttttactgagtggcttgcacttctaatctcttttgaccaccccccaaccagcaatcccccatatggtttgtctgtatccccacccaaatctcaccttgaatcaattgtaattatgctcacatgtcaagggcggggccaggtggagataattgaatcatgggagtggtttcccccatactgttctcatggtagtgaataagtctcacaagatctgatggttttataaatgggagttcccttgcacaagctctctcttgcctaccactatgtaagacgtgactttgctcatcattggccttccaacattattgtgaggcctccccagccatgtggaactgtgagtccattaaaatctttttcctttataaattacccagtctcaggtatgtctttattagcagcatgagaacggactaatacaacccaccccccaccctcacacacacacacacacacacacacacacacacacacttacttaaaatagataacagagagtcatctggagtcttgaccctaggcttattgctgcctccacacagatgcaagggcagcatacaaccaaggcacagttggagagatgaggcttagataaccccccagtcagcctcctggaataaaggaggatttccaggtgtctgtctgtcactggcccctttgcctttgaggggactccagtggttccccttgtttaaccacctttcccctctacaattataggagggaccccttgcctcccaactgtttaagtgctcagtgctagaaacctactctgtgttggccctgggttaaaaagataggtaaggcaaacaagtgacagacaatcccaatacagtttggccagggatctgagagagagaaaagccccaggagactgtgggatccccaagaagggggcctggcctagcctggaaagtcagggaaggggacctggaggaggtggcatttaagccaagttaggaaagaagaatgagaatgagcaaggcaaagactgcactgggctgagctggtctgggatagggccagagaggggtttagaacagatggatgtgtgtggagggcagtggtaactccaagttgttgggtactgccctagcttgaacaggagcaatgagagatggagcagagtgataggcaggggcttgctcaaaaaaagccttgtatgccaaggtcagaatgacattctttatactgaagagttgtaggtcttgaagaactcctagaaatgttactggataaactccgcttggtcatagtgcattattctttttataagttgctgaatcccatctgataatatattgttgaggatttctgagtctatattcgttagagatattggtctgtaatttgattaattgactgactgatggactgcttgattgattggtttttggactagctttgtctgtttttggtattagggtgatgctggcctcataaggtaagttctattttctgaaataaattatgtagaactgctgttattttctatttaaatatttgttaaaatttaccaatgaagccatctgggcctgggcttttctttgtggaatgtcttaaataactaatccaatttctttaataattatagagttattcaggctatttaattcattttgggtagttttagtagtttgtggttttcaaggaattgatccattccatttcatctttgttttttttttttattgtttgtttgtttgtttgttttttgagacagtctgtctctgttgcccaggctggagtgcagcagcgcgatcttggctcactgcaaactccacttcctgggttcaaccaatcctcgtgcctcagcctcttgagtagctgggattgcagacatgcaccaccacacccggctagtttttgtattttttgtagagacagggtttcaccatgttggccaagctggtctcgaactcctggcctcaagtgatctacctgcctcagcctcccaaagtgttgggattacaggcgagagccaccacgccaggccccattttgtcttaattgtcaaatttatgtgtacagttgttggaagtacttccttattattcctctaaggtcttcagtgcctgtgttggcatcccctgtttcattcctggtactgatcatttgtgtctttctttttttctttgtcagtgttgctagagatttgttattttcattgatcttttcaaagaatctgtttttggtttcattgttttttctgttgtttttctattttcaatttcattgatgtctgctccttattatttccttcttttggtttgctttgggtttattttactctgtaggtttttcaggtagaagcttagattattgatttgagatctttcttcttatataagcctttaatgccattgtaggggcagaaagggggtgattccttttctccccatttataaaaggtcatagccaacaccccataacaaaaaacaagttaacaagagaaaaacataacaaatttattatgtgcacatgtgtgcatggaagtcatacaaaacatgaactcaaagagggaccagatggttgaggcttaaatgctctcttcataggggaatgggaaatggatgaacaaataggcccaatgctcagacaatggtttgtaaatgattctccttggaaagatgagaggcagaactgcacaggaaccaaagttgtcttattatgcaaataaagtctctcagataatctctgggagccgttcttagaatccatgaaggtttgtctgggcatggtgatgactcccagtctcttctcttctccagtggttgatctttcctggttatttcatgagatccctagggtggaggtcttaagacaattgcatttcttttggaaaaaaatctttcttaggcagataaggaaattccagagagagagagagagagagtccttccctgtgcttgggggaaaaggatcagaaaaacaaggaagtgggggatggcgagcgggggttgttcagagagagaccttggctatgaggcttatttctgaggcctttcaattttcaaagcagtcagcatgccaaagagctatgttttgggggatttttttctgcaccccaacactacaaatttccatctcagctttgcattaaccacaacccacaaaattgatatgttgtattttcatcttcattcaaaatatcttctaattttccttgaatctttctctttgacccatgggttacttagaattatgtggtttactttccaagtatttggagattttctttttatctctctgttattgatttctagcttgattccattgcagtcaaagaacatattctgtaatttcaattctttttaaaaaatttatttaaatttttttattttttattttatttttatgttgttgttgttgttgttgaaatggagtcttgctctgttgcccaggctggagtgcattggcgcaatctcggctcactgcaacctctgcctcctgggttcaagtgattctcctgcctcagcctcccaagtagctgggattacaggcatgtgccaccatgcccagctaatttttgtatttttggtagagaaggaatttcaccatgttggccaggctggtctcgaactccggacctcaggtgatctgcccgccttggcctcccaaagtgctgggattacaggtgtgagccactgcgcccggcctaaaaaattttttaaagatgggatttcgctatgttgcccagggtggactcgaattcctgggctcaagcgatcctcctgcctcagcctcccaagtagctgggacaagtagctgggactataggcatgtgtcatcacacctggttcttaactcttacatttgctgagacttattttatcactgctatggtttggatgtttgtcccttccaaaattcatgttgaaatttaattgccattgtaacaatattaaaaggtaaaacttttaagaggtaatgagatcccaaggcctctcccctcatgatggaattaatgcccttatgaaagggcaggtttggcctcctcttgcctccttcctctttgttcttctgctatgtaagtaatagcattcctcccctccagaggatgcagcattcaaggcaccattgcgggatcaggtccttgccagacaccaaacctgccagtgccttgatcttggacttcctagtatccagaactctgagaaataaacttctgtttattacccagtctcagatattctgttataacagcacagaacagcctacaacgatgactcaggctatgacttatcttggtgaatgtcccatgtgcacttgaaaagaatgtatattttgctgtagtgagtagagtgtcgtttcaatgtcaattagatcttacttggttgatgatgttgagttcatctataacacttgctgactttgtcttagtcatgtacatttttaccagatttagggaaataaagtgcagccctcacttgatacccgctgctctggggattgaatgggggatggtgaaatctgatttaaggggtgccagtacaaaaggtctccctgacttcaagtttctcttacacacaggtgcaaaatttgatgatgttcaccaacctaaagcttcttctccagcaggaggcccctgagattagatacatttctctgattaagtcttttccatccacacagcaggatatttagataggttggcctgcaagagagttttgttgttgttgttgttgttgtttgtttttgagacaatgtctcgctctgtcgcccaggctggaacacagtggcgcaatctcggatccctgcaacctccgcctcccaggttcaagcgattctcctgcctcagtctcccgagtagctgggattacaggtgcacgccatcatgcccggctaatttttgtatttttgtagagacggggtttca[142 bp omitted]aagcactacattggagtttctattacatttgtctctatcacagctttgccttgagccagtccctggctctgtgagcctgtaggagcctggcatgaaggacctcagaatgctggcagctcccatagcacacatgaaagtaaaggaaaccttgatgttccttgactgatgtggtccaggggctttcccagggttggtcctgcccagccccatgcccatgctcatatgagcacagttcctgtgggttgggcagaccagaagataatccatctgaaagatggcatcttcctttctttcttctctggggcagtgccagtaagagccaccattccctactcacatgtatttgctccagcaccaaggagcacactgccctctcctcccaccagcgcctacacatgggccttgtacacccccaaacatgcacctccagtcacagttttccctctgagcagtggggtgggagtgaaggcataagaaattgggtagggggttgtgtggagaaccccatattctcttagctatattttcccactcttcctctctcttccttcctcccaaattatggctggaacacaggtagggacttccaagggggctgtgtgggtggggttaggtgcagaagaaaaagtagtcaaagagagtagttcttaatgatcaatggatcccagagcctttgggaaatttgataaaatagttttgggctttcttcctagaaaaacaatgcccttgggatggacccacagttattcctgcagttttaggagtgtttgtaacctcctgaggagcagtccttggggcccactttaagaaactctggattacaggaagtggcaacctatctgtccctcttccccttcagatgggagaaagcctcctttctctctaactcacaaagcatcccctctatcctcttgaatgaccaagattacttcttatttttatattcaaagacaatagccagatagtaaagctgtagcactagctattaacctagaacttaatcaccaaagaatgattctcttagtttcacatttgatctcattgatttgtgcttccagtccctagccatttgggctgtttgtgggggttgatttttctggatatcattatgtctacagagagagtgtgatactagggtatcttgggtgactgcagatttatgcaaagtgagatatagggagtaaagggtgaaaagggtgccacacgcttgaacttggttgcagcaccaagggaactttaaaaacttacatgaatattgggcttggaaggtttggtggggtgtctgaatccctgttaatttttatttaccccaaaaagtaaataaaaattatttatatagtacagcccaagatcaaaacgcatcttgcatcattttatgatgttacttactttgtacttttaaactgctcaatctcagactctctcaaccaacaaaattattttgattattttattaggcaaaaaaaaattgacttggccatcctcctctatctcatctgtcagtctggtaagcgttttttctgggagatcccaaggactgtggctaagtcaacttgatttgcacttattttttcccactgccatgtccaaatcattcagcactgtcgtcctagacatgaggctgccgctcaggcccagactcccaaatagttgtatgcaagtaaccccagctgctgaggctgggaggtacttctgaaggtaacagaagaatccatcttcctgcagatttattgaatacggtgtcagcttccttcccatctatttccaacatatgcagacttctgtgctctggtgactctaaaggataaacaaagactgtggtcaagttgaggggagcagttaaatattgtgatgccctgaaatgcttgaaacatatttcctgcatcttagggtactgacctcagatcctagagctagataaaatgcaatgggatctgttttatagagtggtacagtaaataaaaccatttcaggacaaaagtgaaaaccataccatcctatatctcattcagctatgcaattttccttttaaaattttttatttttattttttactttttaaattattagggtatttctacatttcaaaactcaaaaagtacaaaagacattcagggaaaaacctccttcctatgtctgttcccacccaagttcccttaccagaggcaagcactattattagttccttctatatccttccattgatagtctatgtatttttctgttttattacctcctctcaaagtttggattgggatttttgggcagcatttctagtttgtttctgctagaagtgtttgtgcttcacttgtaataataggtcacaggacaggtcacagcctgctctgcaagacttagcatctcatgtactgcattttaagcatttttattccatcccacaagaactaatgctttgcatccttctctaatctctgtgagggaccccaagacgagtaaagcctttatcactgccctaaggatcttctttgttagttggggagacaagactacccatctgaaacaaatgacaggagcagatggagtgcattgctgattcatgggactggttttttgaaaactttaaatgccaggaggaagtttggctttgatactgttggtcttttaacctggtggttaaatgtttttggagtcagagtaaatcttggctccaatgccagctctggtgcttaatcaattctcttaagctctctgagccccagtttcttcctctgtgatatataagagtatcatttactaccatggattggaggagatgatgaagatgcagcacctggcatgaaatgggtgctcaataagtgggttgattgtgctttttgccggagaaactacatgaaatttggggccattaggacaccatgcatgcatgtgcatttgtgtccatttgtgtgtgggtgaggggaggaggggtattgacaattaagtctatgagctctaaggcacatgagcaagacagaggcagggagaaggaacagatggaaactctgctgatgcatggtagctgatgctgaatccatggggctgagcttcccagttgattgctaaggcaggaatgggatggggtatctttaacagcttctgagcatgatcatgacatgccaaaagtaatgtctgaaaggattcatctgggagtggtgtggaggctgatatgctaagaagcagaaatagaggcagggagtccagtaaggactgtcatcaaggtgatagattctcaaaactgatgctttgttgggtatgaaggaaatggatgagttaaaggtgaccatagagtttccagccagaggaaatggatctatgacactgcctttaagagaaagaacaagagaggggagctcagtttggaggggaaagaaagggcagtatgtgtcctggggacagcaaggcaactaaatgaaacacaacactccactggagcaggtagcttgagactgatccctgcaaatagaaggaatgcaactggaaaggtttcatatcttagggggatcctaagattggccagctccccaatttccttatccctctagcattctcaacagaagaaatctgccttaaaggagagagggagaagcagaatgtgactatgttgacttgagattagggactgtctagattgccatggtgaccaggacaagaaacgtgatgcttttaccatcaagcatatcttccagctgtattccgttatacttcctgctaacgaaggttctgagcagctctgtttgccccgtagtctgaattgagcaaggaatagacctggggctgcaccctgacaggctgtggagatagattcgaaggcctcagctactccgcactgcactaaccctgaggtctgtcccatgattgcatcatctcagatctgcctggtcactgaagcctagactgggtgacaaagtgataacctttgtgataccaacttttcaagtgctcattattctgggtacattcctaactcccctgtcctggtggcctcttctcttgtgcttgttgcctagaagatgatgtaggcaaaactgctcagaggacaacatagagagctcattactggagcatgacattcagataaaaaagactacatattttccagaataggcaaattcatagagatggaaagcagattagtggttgcccgggtccaggagaggaagaaatgaagagtgacagctaataggtacaggcttttcttttggggtgatgaaaacattctgaaattggatagtgatggtggtggttggccaacactgtgaatatacaaaaaataaataaattatgcactttaaaggagtgaattttatatgtgaattatagctcaataaagctgttatataaaaaaaaaatcaggtagatttctgcatctgtgtctcatacaaagcccttaaatatgtatacacactggaggtagctgcattttcactgtcaaattgctcttaagagttgatattactatattgatatttagcaatagcttttaagttttctaaatcctcttttgctcaaactaagaaagcctgagatggggtaaaggaatgtggatggagggctattttctctaatgaggaggctatagggtgaaaaaaagaaggtttcaaccaaatctaccaaaacaaaaccaaaagcccaacaaactccatgaaagtggttggtacacacatttcagagaacctagggtttttcgttggccttggcagtaattctgaggagcattgacataaggacgaactgtgttccccttattttcctgagattctaggcataagcatgtctttccttaacatctggcagacatttaattcacctccccattttgaatgagctattgtgtccagaattggtgggttcttggtctcactgacttcaagaatgaagccgcggaccctagcggtgagtgttacagctcttaaggtggtgcgtctggagtctgtcccttctgatgttcagatgtgttcggagtttcttcctattggtgggttcctggtctcgctggctcaggagtgaagctgcagaccttcgcagtgagtgttacagctcttaaggtagcgcgtctggagttcttcattcctcctggtgggctcatggtcttgctgggctcaggagtgaagctgcagatcttcgcagcgagtgttacagctcataaaagcagcatggacccaaagactgagcagtagcaagatttattgcaaacagcgaaagaacaaagcttccacagtgtggaaggggactggagggggttgccactgctagctcaggcagcctgcttttattctcttatctggccccacccacatcctgctgattggtagagccgagtggcctgttttgtcacggcgctgattggtgcatttacaattcctgagctagatacaaaggttctccacatccccatcagattagttagatacagagtttccacacacaggttctccacggacccaccagagcagctagatacagagtgtcaattggtgcattcacaaaccttgagctaaacacagggtgctgattggtgtgtttacaaaccttgagctagatacagagtgccgactggtgtatttacaatccctgagctagacataaaggttctccacgtccccaacagagcagctagctacagagtgtcgattggtgcactcacaaaccttgagctaaacacagggtgctgattggtgtatttacaatccctgagctagacataaaggttctccaaggccccaccagagcagctagatacagagtgtccattggtgcactcacaaaccttgagctaggcacagggtgctgattggtgtgtttacaatccctgagctagatatactctccacatccccaccagactcaggagcccagctggcttcacctagtggatcccgcaccagggctgcaagtggagctgcctgccagtcctgcgcggtgcgctcgcattcctcagcccttgggtggtcgatgggactgggcgctgcggagcagggggtggtgctcattggggaggatcgggcggcacaggaactcaaggagtgggtgggaggctcaggcatggcgggctgcaggtcccgagccctgcctcgcgggaaggcagctaaggctcagtgagaaatcgagggcagcgccagtgggctggcactgctgggggacccagtacaccctccacagccactggcccgggtcctaagtccctcattgcccggggccggcagggccggccagctgctccgagcgcggggcctgcccagcccacgcccacggggaactccagctggcccgcaagtgctgcgtgcagccccacgtcctgctggcacctctccctccacacctccttgcaagctgagggagccggctccagccttggccagcccagaaacggaatcccacagtgcagtggcgggttaagggatcctcaagtgccgccaaagtgggatcccaggcagaggaggcgcggagagtgaacgaaggctgtgaggactgccagcacgctgtcacctcagtggcgcacacctgtggtcacagctacttgggaggttgaggtgggaagatcattttgtgaccagaattggtgggtttttggtctcactgacttcaagaatgaagctacggaccctcgcggggagtgttacacctcttaaggtggcacatctggagtctgtcccttctgatgttcagatgtgttcagagtttcttccttctggtgggttcgcggtctcgctggctcaggagggaagctgcagaccttcaccgtgagtgttacagctcttaaggtggcgcgtctggagtctgtcccttctgatgttcacatgtgttcggagtttcttccttctggtgggttcttggtctcactggctcagcagtgaagctgcagaccttcatggtgagtgttacagctcttaaggtagtacgtctggagttgttcattcctcctggtgggctcggggtcttgctggactcaggagtgaagccgcagatcttcacggtgagtgttacagctcataaaagcagcatggatacaaagagtgaggagtagcaagatttattgcaaagagcaaaaaaacaaagcttccacagtgttgaaggggatcggagcaggttgccactgctggctcgggcagcctgcttttattctcttatctggccccacccacatcctgctgattggtagagccgagtggcctgttttgtcagggtgctgattggtgcgtttacaatccctgagctagatacaaaggttctccacgtccccatcagattagttagatacagagtttccacacacaggttctccacagccccaccagagcagctagatacagagtgtcaattggtgcattcacaaaccttgagctaaacacagggtgctgattggtgtgtttacaaaccttgagctagatacagagtgcccattggtgtatttacaatccctgagctagacataaaggttctccacatccccaccagagcagctagctacagagtgtcgattggtgcactcacaaaccttgagctaaacacagggtgctgattggtgtgtttacaaaccttgagctagatacagagtgccgattggtgtatttacaatccctgagttagacataaaggttctccacgtccccaccagagcagctagctacagagtgtcgattggtgcactcacaaaccttgagctaaacacagggtgctgattggtgtatttacaatccctgagctagacataaaggttctccaaggccccaccagagcagctagatagagtgtcgattggtgcattcacaaactttgagctaggcacagggtgctgattggtgtgtttacaaaccttgagctagatacagagtgccgattggtgtatttacaatccctgagctagacataaaggttctccacgtccccaccagagcagctagctacagagtgtcgattggtgcactcacaaaccttgagctaggcacagggtgctgattggtgtgtttacaatccctgagctagacataaaggttctccaaggccccaccagagcagctagatacagagtgtccattggtgcactcacaaaccttgagctaggcacagggtgctgattggtgtgtttacaatccctgagctagacataaaggttctccaaggccccaccagagcagctagatacagagtgtccattggtgcactcacaaaccttgacctagacacagggtgctgattggtgtgtttacaatctctgagctagatataaagactctccacgtccccaccagactcaggagcccagctggcttcacctagtggaacccgcaccagggctgcaggtggagctgcctgccagtcccacgccatgcgcttgcattcctcagcccttgggtgatcgatgggactgggcgccatggagcagggggtggtgctctttggggaggctcgggccgcacaggagcccatggagtgggtgggaggctgaggcatggcgggctgcaggtccagagccctgccccacgggaaggcagctaaggctcggtgagaaatcgagcgcagcgccagtgggctggcactgctgggggacccagtacaccctccgcagccactggcccgggtgctaagtctctcattgcccgcggccagcagggctggccggctgctccgagtgcagggcccgccaaacccacgcccacggggaactccagctggcccgcaagcgccgcaggcagctccggttcctgctcgcgcctctccctccacaccttcctgcaagctgagggagtgggctccagccttggccagcccagaaaggggctcccacagtgcagcagcaggccgaagggctcctcaagtgccgccaaagtgggagcccaggcagaggaggtgccgagagcgagcgagggctgtgaggactgccagcacgctgtcacttctcactatcaagggtgttctcaatatgcaatccagcacacatcttcatgtacactgtggtgaatacgtcccctcagagctaaatgaaattcagttcaacaattgtttatctagtgcctaccatgcacaaggcaccatagaagaacaaaacagctcttcaggctctcttctcctcctggctgtgtaattgctctccagagtgggtgccaaattactccagggaaagagaaaggtgtgatgagcacacaccaaaatcaggcttcactcctgtccaaggttagctctgcttctgggtcaggctgggagtcctgaaacacttctgtgggatagtcatagtgggataatagttcatagctgtgcttggacactctcatgaattgatattaatttatacccatgagatgtgtctggcaaatcattttgacactgctgtcaacactgagggctgtctgcctcatgaacctagagaactaatgcagtgctgtatttgcaaagccgccaggccctaaacagggctctgccacaaactcaatgtgtgaccttggctaaatcagccatcccccatttctagtacattctcctttctaaaatgagggaaaggagtgtgactaatttttatcaaaggctctttccagtttggccatcttatagtttatgtaaccataggtaaagaagtgtatcaacttaaaagagcagagataggaggaggttaatgctgagaccaggattgagaatcagtgggatacttcccgaggccaagaaaaaagaggtaggaagcaagaaggtatggcctgttcagtttgaagtttatatgggctgatttccatggagaaacaggcgggtgatctcttgggttttgtgctagcccttgataaagaagaaagccagtggagatgggaattgttttagtgactggttaagaacctttcttaagttcataatgattacaataaccccaatgaggctgaccttagaagttgtctgcgtttaggacgaaatgattcctttgtccctcatcaaatgcctcttttcccagcttactatttacaaaccaaaccaaaaaaaaaaaaaaacaacccacactcaaccaacaaatctcagtaattatattaacattgatagggtatgcttactatgggccaggctctgtgctaagaactttatttccttccaatatctcatttaatcctcccaacaactctgagatagggactattactgccctttttctgcagttgaggaaattgaggcaccagtctgtgctcagagcgtttgtggaaactaagggggataccagaaagtagaggcatgggacagtacattccctaaatctggaatagttctattaacaaaaatcatgtcagttacccaggataaagtcattgaaaggatttgcaggagccaagggagagcacagattgcttgctagtggaaacttttaattttctagcttaaggacaaattttcagtttttagactgtcccctaaaaaacacagccatgacttatctcacaatttatgtagtgtgcctttaacagttttatcgtgtttcctacgattaccatctttcactctctggaaagcagaggggtggtatgtgaccttctgtctccgtaccttcctcaaatgcccggctttgccttcaacatgaaaaaaatggacaccttccctgggggaagaggacatctatttccaaaaatggaaggaagaatctaactctgcaccccccggcctcccgcctccactgccctagccctagccccaagcatggtcacagcagattgctcattcttcaaacgtatcatgttctttccatctctgtgcctttggacaggctgttctcaaagcctctcaatctcttcccttctctgtcaaacaaatacgaattcagccaagatccatcttgtgaaccccactgcccacgcaccccatcccccgacttccagaagagtggatttctttgcctttcctcgggcaccaaggagagcattcgggtatggcatgatacagtcagtacatgcagggcaaaccagcaattaggctactctcttcaactgtgtatcctctccaacacacacatataccacatgtacacatcttacagagtacaatagagtattgcagttaagtgagtgaactcgagatccggacaacctagatttaagtcccagctttgtcactaactaaatgaatgacccttgagaaagtgcctgaaccactctgtgactcagtcatctcaactgtaaaatggagataataataagactcctctcaaagagtcattttaaggactaaatgagattaaatatatgaagtgcacagcacagtgtctgacatatagcaactgctccatcagtggtacccagtattattattgcacagagcttggtgcatagaggatggcaaatacatatttgagtgggtatctgaacacagtaagtctttaggggattaacttagggagaggtcagggacagttgggctactcaaggaagctgttttctcctgacctcattactctctcactgcaccctgttttttccttcactgcatttatcacaatgtacaattattacatgtgtttgattacttatttgatgttgatgtttcccaataaactaagtttcatgacgccagagtccatgtatgttttaaccaccaccatgtctcctgtacctagaacagtgccaggaagatggtaggtgctcaattaaagaattaaaaaataaatgaaactgagttaaagaataaatgaaagaagaattcaggagtgatgtggtggatgtaggtgtggtggatccttttgaaataccttgtgtttttcaaaatggcctgaactgatgtgatggatgtaggtgggcctgaaggataagtaagagttgagttggtaggcaagaaagcttctaaatggaagggaatcctgggaaactccagcacttggtggtggaagatgcagcgaacagggtgcaataagtagatcccttggtctggaagaacaagagactgtttctgtagtgtagtttacataggggagtagtgagaagactggtagggggttgtagtgaatggctttgaatgccaggctatcagggattcattctattagcttaggctttggcctctattagcatgcaaatattcctgggaaaaaattatatattctcagccaagtataagtgtgtataaattagtttacttgctctttgccttagaaaaaaatttgccagaggggaaagcgatagcaggaggccactggaaagagaaaatagtgccccgagataatcaaaagcatataaaggggaaggggaagacaaaccttacttatctccagggttgtgatggtccagaacctgaacctcaaactttctatagtttgtttcatcacaaaatgactcttctttattaaaagtgcaggcaaggaatacgggtgttaaggaggtttttaatcactgaataaatctgttacctgtttataggtctgatgagtgtttgaaatttgtttatcttgattatctaatttattatctatggtttcctgtgtcattaaaaaaatctttgtaaacatcgtttctgatggctgcatgacattctatcatatggttgtcccataatgtaactattctcttaatggttctcctctagttattcacaaggctgacatgaataatatctttgtaccacaatctttatctgtactaccactatttccttaagaaaaattgctagacatgacatttttagtacaaaagacccaaaatttcttaaggttctttcatcttgccaaactgccacccagaaaggccagagcaatttttcctcctcaccagtacatgaaagagctttataatgttgagggtcatgatttttaaaacatctttgctgccaggcacagaaagacaaataccacatgttctgacttatgtgtggaatctaaaacaatctaactcataagaggcaagaatagaatggtggttaccagaggctgggggtggcggtgggggttgagaatggggagatgtttgtcaaaagatacaaagttgcagttatgtaactgacctaaggcttcttcctgcccagtgcaaaaacaaaataaattcaagacattacagtaaagaaagagtttaattgaccagaggcggaagtgttggaggttaggggtttttcaaagataatttcgtgggcagggggctagggatggggagtgcagtttagttggatcagagattaaatcatagggagtcgaagctgtcttcttgccctgagttgcttctgggtaggaccacaggagtggttgacaggtccaggtggaactatcggtggcagacatgcaacgaacctgaaaaagtatttcaaaaggccaatcttaagttctgcaatagggatgtcatctgcagcagtaattgggaaagttgcatatcttgtgaccccgggaataatggtgggtaattgtttacgtctgcaccttagcagaattcaggctcctcttatcctcttagcctggtggtctgtccttagctttacaaaggctatgagttatggtgaaaaactattatcatttaagctataaactaaatgcctcccaaagttagcttggcttaagcctgggattaattaaaagcagcttgaaggctaaaggcaaaagggaggttggccagatcagatctccagtcccccaccacgttgccataattttctcactgatatattttttgcaaaggaggtttcagttgggagaaataaatggtaacttatttcagtaaatgatgtgattgttttttcccagattgcaaatcatccctgtaccacttattgaataatccttccctttcccattgaattgtgatctttcctttaccttataaattcatatatatgtatgtatacacttgtacatatacacacatatttttgctttattttgtttgtaggctctctatctgacccattgatctgcctcttcttgcagcactatcactgctttaaatgttgcagttttataatacattttgatagcattactcctctgcctcaaacttttcttagctatttaacttagttcacatttccagacaaatattacaatcattttgttaggagggccggttcctgcccagagcctacctaagttacatgttttgggtgctgcctaattcatctactttgatcatgagacatactcatcctcataatgagaaatgcaaaagcccaaataagccaggctctaattctacctttggctttcacaccgtctttggctcctaaagggaagtatcaaaagagggaaaatattttgtccacactgaagagctgaaatgaaaaggaatcatttaccatgccaatcgtattttttttattttatcacagaacaattggaatgtaaatcaatcattttcaaagtatatctttccctctgcctgaagtggaattactctctaaagtgacaaacattagtatcttatctatgtatttatttttgtttcattactaacatcatggaattacatttacaaatgctctcagctttgtctctgtgtctatggaaacatgaattacttagccttttggagcctcagttcgctcatatggaaaatgacaataatgactccattgtgcaaaatgcctggctcactgttgaccatcagtaaatgttggctatattatataattatgacaggtagtagagcattttggttcagagtacagcctctggagccaggcttctttggttcaaatcttatcttcatcagtaaatgattttctgatcttggataagttagctaaactgaatgtgccttgatttcttcttctgtaaaatgtgttaataaaattacttgctttattggttgtaagaaatgagttcactctgtcaatgaagagtcaaactgtaaaatatttgaagagatgtattctgagccaaatatgagtggccaatggcccatgacacaagccccaggagatcctgagaacatgtgcccaaggtggttgggctacagcttggttttatacattttaaggagacatatcaattaatacaggtaagatgtacattggttctatctggaaaagtggagacatctggaagcaggggcagaggtgagggggttgcttctaagtcatagacggattcaaagattttctgattgccaattggttgaaagagttattatctaaagacttgaactcaatggaaaggaatgtctaggttactataagggattgtggagaccaaggttttgtcatgtagatggagcctccaggtagcaggcttcagagagaatagattgtaaatgtttcttatcaaacttaaagagtctgttctatcagtcttctttttttttttttttttttgacagagtttcgctcttgtctcccaggctggagtgcagtggcacaatcttttggctcactgaaacctccgcctcccgggttcaagtgattctcctgcctcagcctcccaagtagctgggattacaggcatgctccaccatacccagctaattttttgtatttagtagagatgagatttcaccat[137 bp omitted]gtcagctgtgcctgaattccaaaatggagaaggttataatgaagcatgtctgacatccacttcccatcatggcctgaactagtttttcaagttggctttggaattcacttagccgaggggagagtccatcagttcgttggggggttagaattttatttttggtttacaactctatcaaacatgtagaacagtttctggcatatatgaggcactcaattaattttagctattcttgttgacagtatccttggtgatagtgttattggcgatcttaatccttattatttgggcaacgacacaatcaagaacatattacctcatagcaccatctagtgcttattttggaaaatgccaaatccctttcccttgaacaacagtcatttggtgaggagaatttttaaaattccaattttaggaatacaaaaggagtttggaaatatcatgatttcaaattttctccagcctatctgggcttttatttataaatgtcagggatcttggttgcaaaagacagaaactgactctggctgaatttagcaaattattgggcatttcacagaatcaacagaaaggcaggtaaaccaggataaagaaatgatcaggaatcatgggaggacctcagtcaagatttgccataggaccagcttggttggtatgtcactactggcaacaaccaccttcactgcctctacacaccaccaccacaaaacactgctacatctggactctactgatctgacattctggtctgctagatgcagtttctatgaatgaattcaaaatggccactttttgtataaacctctcaagatccaaagtcttcagtaagagcctgggtcccctatggactccctgaccactcagggcttgtggagagggaatatgtgcttcccttagtttccacagtaagaggcctcagccttgttttccaggctcacaatggaggaatacctcaaaaaagaagagagtttggacatccacatcaagtagggttactggataaaatacaggagacacagttaagttggaatttcagaaaaacaatgaacacatttttagtatgagcatgccaatattacatgcagcatacttatagcaaaaacttgaaaagatgaaaatgcccggtttaagtgtggagggtacagtgagacgagtactcttgcatattactggttggtatgcccattaatatactcaagtggattaaaaatattcacaactgctgaccctcaaatactgtttttaggaatcttcatagcctatgacccaagagctgaattttaaggagtgtatcctaagaaaatgatcagaaataggcaaaataatttgtatgcagagtgctcattgcagttactgttcataaagaaaaattggaaataaatctaaatatgcaagataagagaatggccaaataaattgtggcaaatacatatgatagcatcttatacagtcattaaaaatatgttcatgaagaattctagatacgtggaaaactgacaaagaaatgttcagagataagagcagggcagataatagcatatacaactcactaactgtaatcttaggctacttaacctctctctacctcagtttactcctccgtaaaatggcataataatagtaataagaatggaacttggaatagtgctttgcacataccaagtgttatgtgttggctggagtgtgtgtgtgtatatgcaagtttgaggagggggcagaggagacagagatggcagtcaagggacttttgcaataattgcagcaacctaagtcagtgtttccatgtctcagtctctagtttcatggttgctgagagtcagtttatggtggcagtggtagtggctcagcttccctgggctgcaggtatggtgttctattcttttgttttgttttgttttaattcatcattgtctttattttatagtaggaaaactaaggcatttcatgaaaaatgaagtcaattgtacaatgcataatacagtcaaagatcttgacacagaattggtgtcttaactatcatttctcacctttaatcaataaacattcctctttaaagacaatgaaaaattacttatgttaaatatagaaaaaataaacatcattaattaaacactacatctgtaacctctttacattcattaacactcaggagtaaaaacaataatgatttttgctatggcttcgtgtttctttaaaacattaactaaaatagatttctaatttgggaaacataactaatgctatttggtttttaaaagaattgtatcttaatcatcaagctaaagacatagcaagaaaacaatgacatggtcacttgaagggtgtctcagtctaattttcaccatctaataagacacccttaaagtaattccaacagaaagtctaagaaattcatcgatcaacttcctaagcacatcagggaaggtgctaaaacagtggacatcaagaacaacagcagcagaacatcttatttaaacttttgagataataaaacaatacagaagtgggaacccttgtgaaattttttttcttgttttggttaacaagatcattaatactttacaaacctcatacatgtggcacactgtaaggtttaaagaataaaataagggcctttctgcccatggacgccgccgaagaagcatcgttaaagtctctcttctcccttccgtcatgtctaagtcaaagtctcctaaagagcctgaacagcagaggaagctcttcatcggagggttgagctttgaaacaaccgatgagagcctgaggagccattgtgagcaatggggaatgctcacggactgtgtggtaatgagagatccaaacttcaagcactccaggggttgtgggtttgtcacatatgccactgtggaggaggtggatgcagccatgaatgcaaggccacacaaggtggatggaagagttgtggaaccaaagagagctgtctcaagagaagattctcaaagaccaggtgcccacttaactgtgaaaaagatatttgttggtggcattaaagaagatactgaagaacatcacttaagagattattttgaacagtgaaaaattgaagtgactgaaatcatgactgaccaaggcagtggcaagaaaaggggctttgcctttgtaacctttgacgaccatgactctgtggataagcttgtcattcagaaataccatactgtgaatggccacaactgtgaggttaggaaagccctgtcaaagcaagagatggcgactggcttcatccagccaaagaggacaaagtggttctggaaactttggtggtggtcttggacgtggtttcagtgggaatgacaactttggtcatagaagaaacttcagtgatcgtggtggttttggtggcggctgtggtggtggtggtggatatggtggcgtggggatggctataatggatttggtaatgatggaagcaattttgcaggtggtggaagctacagtgattttggcaattacaacaatcagtcttcaaattttggacccatgaagggaggaaattttggaggcagaagctctggcccctatgatggtggaggccaatactttgccaaaccatgaaaccaaggtggctatggcggttccagtagcagcagtagctgtggcagtggcagaagatttaaattaggaaacaaagcttagcaggagaggagagccagagaagtgccagggaagctacaggttacaacagatttgtgaactcagccaagcacagtggtggcagggcctagctgctacaatgaagacatgttttagacaaatactcatgtatatgggcaaaaaactcgagaactgtatttgcgactaattgtataacaggttattttagtttctgttctgcggaaagtataaagcattctaacaaagggttttaaatgtagatttttttttgcacccatgctgttgattgctaaatataacagtctgatcgtgatgctgaataaaggtctttttctaaaaaaataaataaataaaataagcaagagagctccctgaaattagaaacactgcattataataaacccccccccttttttttgagatggaatctccctctgtcgcccaggctggagtgcagtggtgcaatttcggcttattgcaacctccgtctcgcggattcaagcgattctcccgcctcagcctccctagtagctgggattacaggcgtgtgccatgacgcccggctaatttctgtatttttagtagagacggggtttcaccatgttggccagggtggtctcgaactcttgatctcaagtgatccacccgcctcggcctcccaaagtactaggattacaggcgtgagccaccgcacccagccgtataacttttataggcacacacttccttaagtttcaagcaagttgaaattcaacccttattattcacaaggacttcaaatagaccagtttacaaacaagcatgagcaccctacaaacggctcttactacggagttcttaggataaacgtgtttatactttgaacagtcacgtgagtatcataaagatggcgattgtatatcactttccagtgaaattgcttgccttcctttatgatttcttcagtctttttttcagcagacaaaagattttctaaaaagtctgaatattctaagtatagctcatcacctggtaaaagctagagcatcccatcagcagttaacaaggtgatcggcagccatctttccagtccttctaatgcacgatccaaacaaaatttgtgcaaatcagagagaggcaaaattttcaagtcttctcatttcgtagaactgtgggggtgccagccaaatttcttttgataagaaactttcagttgcctttgatggagatgaccactggcagcccaccacctccgccaagtcggagtagactggcggcggctcgcgcaggcagcataggaagaaggccgcgtccaagaggcgagttgcgaggcgcgagaaaggggtgagccagacgctccagtggtgcagcgcccagatatcgggcgtgcagtcgaggtgcgcgcacagccgcaggaaatggcgcgggtcccgggcgcaagcgggcgcagcaggcggccaggcccggctgcggctggagggcgaggcggggctctggcgcggggccgggcggggaggtcctgggcgttgttctattcttgaagccaatcatcctagcggaggcttcctgatgacccacttttctgtctgagggcagaggtcacagtacccctaatgggcctatttagtgatagagtcctggtagtcattcctacagcccgaggctatagcctgttcttccagcctttccactgatttttgtaagctcttaattccctgtgtcccatccttttctcctctaaataactaagcagtttctgtttctcaccactgaacagcgactaatacaaggatgaaattaaaagttctgtttaggacatgtaaatattctgatacctattgatgtcaagtatgcctaatgtatacagaatctggagtacaggggtaagaccagggtaaaaagtttattttatgcttttttctccttccttttgtctttcatacaaagtttaaatatgtgagtcttaagtatatgaaaaacattaggactgaatgaaatcacctgagcagagaacgagaccagatgctggcccaggacgtatctggggcacactccaacatttaaaagtttggcaaaggaggtgaaaatggtatgggcagctgagaaggagtagtgaataagaaaggagaaaaaccatcaaaggatgtgggatgtatcccagaaactaagtaaggaaagtatttcagggtgtagtgatcaactccatcaaatgttgtactgtgtgtacaaagtgctctgagtgtactttgtactctgagagacagagtccaaagacaaagttacaaaagtgtccatggaatcagaacataaacaagaatggcattgaaggagtgatgcaggcaaaagcccagtagaatgagtagaagagagaatgggaggcaagaatgtggagatgatacatatagacaaccctttgtagaagtttggatacacagggaacagaaaatgcaggggagtagctactaggaagatttggggttaggggaaggtttttggttttggttttggttttttgttgttgttttattttgtttcgttttgttttttttttttgagacagagtttctctcccattgcccaggctgtagcgcagtggcacactctcgcttcactacaacctccacctaccgggctcaagcgatcctcctgcctcagcctcccaagtagctgggattacaggcaggtgccaccacacccagctaatttttatatttttagttgagaacaggctttcaccac[137 bp omitted]tgtttatctgctcataagtacgatcaaggagagaagaagataaactgtgagagccagggttttgagaattaggcaaataaatgcagagttcaaggggaaggcccttgataggagtaaagacattctctgcacagtaccaagaaggaaaacagagaatacagctgcaggtagggtttgttgggtttgatggcagggagatgatagtttacatctaattgtttctattttcttaaagaaatgaaatgcaatatcatcagctgaaagtaagaatagagaggggacactgaaggtttgtagacagtgaaaatggtgtcatagagtcctcacagggaatgacagtgggagagaaaatcgagcacaactgtgtagtataattcttgtacagcataattcacttgtaaattttagtgaaattttttcaggtgagctcttcctcattcattatccccaggtagccactgacctgctttctgtcactatatgttagattgcattttctggacatttacatagatggaatcatatactttttgtcccaaattatttcatgtttaatatgttgttgtggatgttttaatgttgttgtggatgttattgtctctttcttcattttgatttctgattgttcattgctattgaatatttagaatacagaaataaaattgatatttatatatcaatcttgtatcctttagccttgctaacttactcattagttctagtagcttctttgtagaattcgttggattttctacatagatgatcatgtcatctgtgaataaaacagttttgattcttttccatagtttttttttcaagtgagaccagcaagtagagtactgtgctttctactacaatattcagttgtttatgtgcagctagggaatgggggaacagttgggtttaatcacagctgggcttttgaaaaggtctagtgtatgaccaagagagagtggctaatgtggggtagaggaaaaggtggttggaggtgaagaaagtcaaggaagtggaaggtcatggtgtgggatgggtcatccacattgatgttaaagtcacgaaaaatgatggaccagcatcagcttggggaggacaactgagtctggagggaaaggcttcctcagtagaatttacacaccctctgttatgggcttctggggagtcatgggtgcgggtgtgcagaccaggacatggatcctggacactctgggacactgcctcccaaccacaatatgtgcctaggcttgggcatatagctgatccacactcccctcctccccaccctcagagaccttcactctcagttcagctcaaagctctcaataacctagagactttttagaaacaaagtcctctctactttcttcctggcataagtaaagttcagatctccttgtcacaaagccctggccatcctctgtggcaagagtaaaagagagaaagacaaattttgtttagcgatgaacttatagcagaaaaaaacagaagacaattcattttcaattagattatcttaccataccaaaaaaagaaaaatcaaggaaaggataattcccacatattaaccctagatattaaccctagatatttctgcttggtgggaaagtgggatcgctcctgtatacatgcaaagggatggagagagagagagagagtgtgagtgtgtgtgtgtgtgtgtgtgtgtgtgtgtgtgtgtgtgtgtgtgtggtttggggcacatacaagcacaagggaataggggaatatctttgacaccttactgcctgccacttctttgttggtctctcctattttatttaagtcttctgtccctaccctcatattttcctcaggctaaagaggatatccactgtgtgttctatggagcaaaattctctctacttccatccctattcaccagttagctctctttgaggtgacaatggatatgaaagggttaataagattcgaaagaacgtactattgctttagcaaaccactgtgtttcctaggcaacataatgcctgtatttctcttgtttcttcctgtttccaaaagcccctatggagggaatggtaaaaatattagccttggccaacactcaagcccttgctgtttccctctctctccccattctgctcccctcacagttgaccttgcctcctacttcatggaaagcattgaagctgtcaggtttgaattccctctccctctcctcttaaaggagaagctatgatccttccacctgttctttcgatttcatcctctcttgtctcattccatgccacaggtttgattaatatccactctgggcggggtgaggtggctcacacctgtaatccctgaactttgggaggctgaggtgggtggatcgcttgaggtcaagagttcaagaccagcctggccaacatagcgaaattccatctctattaaaaaatttgcaaaaattagccaggcgtggtggcgggtgcctgtaatcccagctactctggaggctgaggcatgagaatcgcttgaacccgggagacggaggttgcagtgagccgagatcccaccactgcactccagcctgggcaacaagagcaaaactccatctcaaaaaaaaaaaaaaagtacccactctgtcctgtattttcaacctctaagccttactacctatcttgctgcaactgaagtctatgatagttttcagaagaacgaaaatcaaaccagggaatccaattccctcttttccctacctcctctgccttagtcaagcttctcaaacttcttttttgagagatagatctcctcaatcctcatgttccactcactccctaggccactggaaccagacttccacccttctcatgccacaataaaaagagtctggcataggtaacccaggacttcctaactgcctagtccaacttacaccttagttttcatctttcttgatccatttacagcccttggcattgtaaacctctccctcctggaaaccctctctcctccctttgcttctatcggaccacattattctgccattttcctaccacttgtggtttttattctcaatctccttggtgggtttctcttcctctacttattcctacaatgttaatcttcccaagactctatcttggccctctttttctctctgcaacctgcctataaatgtcaggccagtcatatgagtaagtaatgcgagtctggttgatgtgtgacaatgtagtatatgccagaaatcacaaagaaatgtgatcttgccctgtttttattttgaaatagtaaccctgttatctttcattttccacttttgatagagtcataggtacaaaaaaattttgattatccacttaattctgctttaacaaaaacagagcaaatgtgataaaagacagctgatacttattctcagcattggggatacagcagggagaagtggggcttctttaggtgtacctgctaaaggaggcagctgctaatcagagatataatgccagatcttctctctctctctctctcttttttttttttttttttttgagacaaagtcttgctctgttggctaggctggggtttaagtgattctcgtgccacacccagctaatttttgtatttttagtaaagacagggtttcatgatgttggccaggctggtttcgaactcctggcctcaagtgatcttcccaccttggcctcccaaagtgatcttctcattttttacgagaacatttttatgtcagaaatacaggttttatgtaaaaatctgttggttaactgcttacatctaatattttaaaaattaaaataatgtgagggtcaaataaacatgtgcttgagccagctgtagtcaccaaggctaacaattttcaaccttggcttagaacattgtgcaatgagccttgaaaagagagagacctctgccctatattctccttgggatctaattcaatgccagtggtttcagctaccacccataggctgttacctcctgtctttacccctccagtctagacctccatcctgagccccaaacccaaatatccaactggacatattactggatatccccaccagaatgctccttatgcccgtgcttttcaaacattaatgtgcatgtgaatcatctggaagacttgttaaaatggagattctgattcagtatgtctggcatactgcccaagatcgtgcattcccaacaagctcccagtggatgccaaagcttctggtttatgaaccacactttaaaacacaatccccatttgcatacaatgtcctttttgcaagtttgctcctcctgctacttatcttctcttgatgaatgatacgccatccacccatgcaaaaattgggggcataagtcagatgtagaaggaatgggagaaatagaggaggaatccaaagctctgtctcatccacctccttaatatttatcatatctacccttgcatttatgtcctcactatcccaacattgatttaagccttcattttctcctgcggtaaggctggtgtccctgctctagtctccacccctccaattgcaacctccatgctcctacgagcatgacactttgaaaaagcaaaatgatctcatgtaaagcatgggctctggggccggagtgctgagtttaaatcccagcactgcctcttactaattgtgtgactttggacaagtagcttaacctatctatgtattggtttttttcatctatgaaaagaggatgataatagaccctcacttgtgagataaataagatttgaaagcaggaaggggaatgacccattagaatatctggggaagagcattccagacaaatggaatcacatgtaaagtgttcatagcactcagtaaatacacattagctgtgacactggccacatcattcctagcttcattatggttggagtgttgagggtaaggagaaagtagaaagagataaagctggacaagtaatctgaggccagatcatggaaggttgagttgcctgggaaagagactctgtgatggagtttactatgtagaaaattgactcaatagtgctcttgggatctacacctgaaatgtaagacaagggagtaggatcgggtggagggagaagctgagcttcagtgcagtcacaatgcagcttccatgaatcccacagggagctctgagcctggtatgactcctcggagttgtccttagatggggaaagggagacaggcctttatatccctgtattggccattcattacctgcaggctgcactaagaaggatctgtgactttgggctagaaagctctctttagcccagcgcaatctcaggaagaggatttcattgcaagctgtcagtcaccaacactttcagcagttggggacctgggagaatgagtgcgtgagtcctgaagtgggggtgggaagtgaaatctgggtaggtatcacaccacagttgggtaaatcatgccaaggactctggacttgatttcactgacaatggggagtcattagaaggttttcctagaatgggacatgctgttttgcacctctgtacctttgttcagaatgctttttttttttttttttttgagacagggtctcgctctgttgcccaggctggagtgcagtggcatgatcatggctcactgcagctttgacctcctgggctcaggtgatcctcccaggtagctgggactacaggcatgtactaccacacccggctaaatttttgcattttttgtagagacagggtctcgcaatgttgcccaggctggtctcaaactcctgggctcaagcagtccaccaacctcagcctcccaaagcactgggattacaggcgtgagccactgcacccggccccagattgcttcttctatctcagtgtttctgacctggattggaatcacttggggtgcttgttcacatgttagaatgcaggtcaaatagcttaatggtaaacagccaaggttggaagcagactcactatatttgaattctgacattccacttactagctgtgagacagtggacaagttccttaacttttctgtacctgtttcctcagccgtgaaatgggataatataaccaactgccttttaggaagagtactcgagttaatccacaaaagggcttagaacattgcctagcaagtaataagtgctcaaacaatgtcagctatttctaaagattctcaggctttcccttagacctattggattagaatctttgagggctggtcctaggaatggacatttcaataagtgccctccccctctccagattattctgatcctcactaaagtttgacaactactggttccccagaaaatttatccccttccttgtccacttggtgaattttttttctttttctctttttttttttttactgataggcttaactggtgccatgaaaatttttaagactcagctcaatgtcatttcctgtatgaaaccttcctagattacacctcccaccatcccttgccaacctcccccttaccatgtggagacctcaaccgcagcatctgtaaccttttgactgtctgtctccccttgctagactgtgagctccttctttgagggaaaggactttgcatccgtaggctcaccacagagtttagcatggagctagagctcaatcaaggttggttgagtggatgtagatgggcaggttcctttggggtctctttaaaatctcagcatgaagtctccagtctctgaaattgggaatgtggatccatatactatcactcaagacatagttggcaactgtagaattttgttttctagtctttaaatttttaaactttttattgcttgttacaataataaaaagagtttatattcactggataaagaagatagcaaaaattacctataatctcacaacccagagataactcttaggtgcatttccttcagatttttttttctgtgcatgggtatttaacataatgggcttccatattcaaactcaattccacaaatatttattgagcacctactacatgccaggcactattctaagcacaaggaatacaacagtgaagaatatagacaaaagcctctgttcttgtgcgccttatgttcaagttggaagagataaaaaaaatgagaagtgatactgtatataaggaagcagtaaatgcaatgggggaaaatgaagcagggaaggaggatgaggagtaggaagaaggtggtgtgagatttgaaagtagcgagggaatgacccatgagaatgtctggggaagggcattccagacaaatggaatgacaagtacagaggccctgaattggaaatatggctgcttgttcaaagggcagcaaggaggccactgtagctgtagtagagtgaccagggaagaaagtggtgagatcctaatgtcttaaaggtaagggtgggtagagtaccgcagatcctgtagggccttgtaggtgctataaggacttgagcttttactctgagtgagatggggagcatctttggatacttaggctgtttccagttttttgctatcatgtatcatgctttgtgattcttctactcaaatctctgttcacatctctgaacacttccctaggggaaattcctggaagttaaatttcttggccacaggctaggaatagtttgaggcttttattgcatattgccaaaggactttctagaaagcctagacccttttacaatataattaagttcaacaaatatttattgcatgcctactatgtgccagacatggtctaggggcttgaaatacattggtgaacaaaatgaatcttgcattctagcaatttcactcttgccaattgtgtcagagtgcttgttttactctgtgcttgccaacaccaagtattaccattcttaaaaagctccaagaaacaagagaaaaaagaacactccagtcatttgaatgatgagaaatggtgcattgtttttatgttcctttggatttatttgcttccttactaggctgaattatttcccaaacattttctagctaatcagccaattgttctatttttctctgaaagctctttaaaacctttgaaaataattaaaaggagacagaaagtttgaaaacactaaaagacttaacatgtatcttgggaaataagtagtccttgggtcaagtacatcggctttaggaattgacttggagccaaagagcatattaaggcaactctcatgttctgaagggggctttttattcaggagcactcttgcttatttccagataacttgagaactgccaccctggaggagaccattccactcagcattgattctgacatgagcctgaatgatgggatgcttttcttcaacaatctctacatcccagtgttagctaatagcccactttattgaacatcaaatctggtttgcaagcatttatatttttaaactgtatcacttcttgaggtcttaagttgcacaagttttctaccctccttgtgaagcaggacttcctttaatccattatcctccaaggggacacagaggtgtagcagaagagacactggactacgataaatgagaattattaatcctccccatccctccatgaaaacactttccccagatttaatagcggttacctttgaggaaagagaatcaagagtgaggagagggacttcagttgtcttctatatcttcccatagtttgaattttctaactttagacaaatattactttgaaaaaacattccagcaggggttatctgggtggggagctaatggcttggtttttgttttgtttttttactctgtgtctctctttattggaaaaaaatgataaaacttttattatataaaatttcccccagttttataaaacaaaatgtgtgtgtgtgtgtgtgtgtgtgtgtgtgtgtgtgtgtatgttgcatgtctgcaagaatataagccaaactgctaatgtatgggcctgatttaagtactgtttggggaacttggagagggagaaaggagtttcattttttactttatacactcacgtattgtttaagtttgttatagtgaacatgtattatcattctacattttttttcagaaaataaataataaaccattttcccccctgaggttaaaagtgacacatgcccattgtggaaaatgtagaaaggtataaggaagaaactaacaatcacaacagttaacattttagcatatttctttccacgctttgttttatgaattttttgacatagttgagttcatactgtatatagttttgtatcctgtttttccctcaagattaaaacacaagcgttttgccatgtcatgatttttggtaaaagaatttaccaaaacagttttagttaaaagaaggtagatttattagataaagtaggaaaatatgttgtcagagagacaaagggcagcctgcaagagagaagccaactgccaggagacaaaggcttgctggaaattttataggatggcgtttatgctgtctgttgaagaggtctttgtgtaatattgataatgccaaggtcgcaatgagctaacttacaggtgtctggtgatagctgggcatgggaagattgtgaattatttgcgcaggaaggctgcatcttggtcatgaagaaagggagatttgtagcttatttgctttttctttttgctatttcatgctcccaccagcctgattccctttccctaattaggactccagaatgatgatatttgaatggccttttaatggttttgtcacaattcaagtgaattaattcgccattttatttgaagtcggacatttaggttgtttccagtttttctgtattaaaaatgaatctctgctgagcatcttagtaatgaaatatttgtctgcgtttctgtctccttgggatggattcctgaaaatggaattactaggtcaaagagcagatttctagaagtgggattaatggatagaaaatatttttatggataataaaaggttatacccaacagcgtatgtgagtctcaccactctctcgccaatagtgtgttatccttttttttttcccttttatctttcctgtagaaaagtagtaggtgacagcggcatctccatgcttttctttttgttactaatgagactgaacatttttcatatgcttattcaccactggcatgctctcttttgtgaactacctgttcctattttttcccatttattgactagaatcttatacattttcttatcaatccaaatgatctctcaaataaatattaaccctttgtcatattagttgcaaatgaaaatattttataagtttattagctttctaaattttcttggccatacatgttaaaagagatagattctaactatagacaagtgccctcagtttgagcctgtttctccatgattaaattgaagagttttgacaaaagatttggaggggctgtttcagctaatcccaaatttagctctgagaaaaatgcctgggcccgatacaaagattgtttggctcattgcactttataatgatttaagaagatgtggggggcagggatggaagcagtttttgccagaaatttttagaattctgaggtaggaagccaatctttactcaagtctcttgcgtgttgggaggaggagtaagttatgtgcaagccaacagaacacttggtggaaaagtactgctctgggctgcagatgtgtgcacggcttggttttaattatttgtttccctctctatcctttcttctcctcccctccccccgccaccagaaaaagggccagattaggacgaggcaaccccttcctccgtggaggtctgcttctgtgcagcctgttagcacatcaaaggccggatgaaatacctaggaaaggaagggaccaggcctaggatccttccaaactcccgcctttgtctgggctccagctcagggttattgtgactgccaagggtagcctgacagactccaaatagaagaacgctgccaaacaaagaaactttcacattattctgaggggggaaaaaagagcaacaagagaacgttgcttgttaatgcctggtgactgagcaaatcagtaattgcaaaagggtttttcggagaacaaacccaaagttaactgggcgatcagattcgtttccccagataatagggagagttgtgcactgactttagcaatcccgggggtgtcggtcccacagcatctgggggagaattggggaagggccatcaaggagagcgaatgggggttcccaaggtgaaaatgagtcgtgtagggctctaacatagaaaatggagttcgaagaatgagtttcctgtctcctaagacagcttggagggcccgggaacggcagggggaagatgaggggcttcagaatgggaggcagggaaaagcctgcagcaacagaaagggagtcggtgtctggcgcgcatcaggtggcggaggggcgctcgcacagagcccggcaatgccgaggccctcccaacgggtcggtctgcgaggagcaaaaaaggggttcagaggagggcagcgcgtgcgtcgcgctcagctataggatggcgcgaggatggcgtgaggctgggctggggcctcccaggtagaactgaggggggcaccgcgcggccgcgggggagcggcgccggactctagaggctttggagggggcctgagggctgcggggcgggaccgagcagggcggggcgcttaggtggcctcgggggaggcggggcttggaggctccgcccctcaggccccgcctcctccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccagtccaactgatcaaaatcagatgtgttaaggttaaggagctcagttttttcttgcagacatttatttattataaaaaataaattttatttattttttagagacagggtctccctcctgtgttgcccaggctggtctcgaactcctgggcgcaagcagtccttccacctccatttcccaaagtgctgggattacaggcatgagccactgcaccgggcctgtggatattttagaatacctgctttctataggcatgtaactgtcaaaatcatttgaaaaccacatacattatttgtcacttagagtagcacacatagttgctttatcaataaacataatcatgtaaatacctgttaatattgagctcaatattaaaggagtgaaaacatgtgcatgaggcatcatcatgactgtagtttgcagagtcattgagaggatgtcagcctgtgcacagagcacaaaactgggagtcaggcaacctgcgttctagtcctgattgggtcatgactagctgtgtgaccttgtgcaaagcattgttctctcagagccttagttttccctctgaaaagtgataaagatggcctattgtgagatctctgtctctatcttgcactgtcattcagtgagcccatgactacgtgacatcttggtagaaagtgatgcttcatgttgtaaaggattcctaaaaattagtcattctagtgcctgttaattctgtgcaaggcactgttgtagatgtgggaatatagcagtgagcaaaacagacacaaatctctgcctatggagcttacgttctagtgaatatatgttgcactgaataatatgtatttttaaaagacttttaatgttcccactagagaacatttaattgtttaaatgtttaaatattctatgaggtttaaatattctatgtttaaatattctatgaggtttgcttggtaaagactcactctaccaagccaatgaccataatttctgaaatggtaaggttcaaaccattgcatttgcctattctcaagcactaggtgctgccatttccactaggggtgtacatttatgaaaaatgtgggcttttttttaccttctttagtgaatgtggcagcatgtaatgatgattaaaaataagcatttttctttggaattttacttgcatttaaaagttgtaaaatttgtaaaaaatttctgagtgtattgaggtttcaggtgaacaggccatattgaaacttgatctattctcatacttggttccctacaaacattttaatgtcagggctgctattcaatctgccttgggggaaacaacacattgtttaaagtacactggattctcttcatttagttgtgcaatatttaaataagtctaaatatccactttgtgtacccacagaatgattctctgctctcttagacaaaagttcagtataatatcacaaataatcacattttatagagttgttttatagagttgttttgcagtattgattcagcctcttttccatgaaaattttagtattttcacagtcttctcaagcccaccaaaaaacagataatgaagactgatctctgtgttatctatttattgacagtgaaggttatgtaatgtggatagatttttaaaccaccgatactgttataaaatggttcttctgcagatgccatgagttaatgtttaattgagccttggaaccaaagatctctataagatacctttgtttcattaaaacatatcagaatatattcataaggaaatgtgttttcatgtacacatcagtgcttattatcttaagaaaccataactctcactggtgtagccccaagtgcctagaactgtcaggctcccagttcaatgttcttgtatgattccctactaccactaccccaagagatcactaaccacgtatgacttttttactagctatttggaaaccacaggagactgacgcaaatgtatagcagtttgatttacttttagttatttaaaagttaaatgacaacaggtctttctgtgtctcctacataatgttcagaatatcagcattactatggtttcctaatggaatttgatattcaaaaatggggctatgttgatgaatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcacttgtaagcatttttaaaattgtgtctgggtcaaatttctaccagtaatggggattcgtggcaggacaatagttattactaagcagcctgaaacttgggtgcattttgataggctccttaatcttggacgcatcaagttcatggcttgaagtaattgtagcagtgctgagtcacttgctatgattgcataccaatttttagccagttctctatggaaacttgggtttctggttttgattttaaaatttttgagagatttgctagattccaaatgaggatttggtgcttggtgtgtcagggaaaggacagtgtccatcttggctacagaaagggattttcataagccctctcttgtagagcttgccgtttaaaagcagcccacatctctgttgaagaatgggagacttgtattctgtgaaacagcttctctttgaatctaattgaacctaactataggcctcatctacaaatgatgcttataatgtgcccagcagcaatggtgtctgcatttttaaaaagaaagtaaaaaggagatgcttgtttctggcttatgctatgggctgaggtctttggggagaaataggaatgaggggttaagttcagattttgagaattcaggaattggtttctgtcaaatctaactgtttaattgtcactctagcaatatttcactgccaagaatttgaataagagtctttcccagcttttatgaaacagtatataaagaccatgagcattatttgaagatttttcatttaaaatgtagttttctatgtgtgttctctataatcagttaaatattacatgttctcttggctatatccaaccattttctttgaaaataatgctgacttcagagagagttctggattaataattagccagatgtgtctctgcctttgagttttggtctcaagcaggctacatataacttccaagtctagaggcaagtttttatactttggaaaacatagttcagttacctaatagagtccctaatttttggcatcataaggatgcctttgtaattagttttctatatgaaaccagtgaattgtagtgtctaacttacaaagctctattttctagggcttgccttcatcagtgggagaaaaagtgtgattttttttttccactttaaggctagccccagatgctgttgtgacacctcagctacacttaaagttggtgtggattccccttaaggcaggtttcccaggagccacctggcttttatttgtctcacacagttccaattgttcccaacggttatttcacacaaaagcagctttagttacctggttagacaggttggttactcctctaattcctactcatattcaggaagaggagactcttggctttggacattcagatgatcgaccctgcattagtttggctacagtgatgaggtggtttgctgatgccatctcttctcaagtcttttgcattctggtttgcacccttacatctgttttctccaacacctccagtcatctcctggctcctttaccacttcctttaaccacccataggtttttctctgtgctgggaaaaacgttctgtctcttgctctcctcttcatctatgagactattattccttcctttcactgtcaaacaaacttcttacaagtttttattcctaaccactacttcatttcctctctataccttcttcctccctacaatatggcttctatccccacaattggattgaactctctttctgaaagattttcagggaaaccttttttttttttcttgccaatcctgacttcacttgtccattccatgttttagatctcctgtcatgtgagcctccagaatggctccctccacagagttcccattttggtccatgggagctccaattttcacttaattaattcatgcttccagttttctttcaaagtacttctcatctgtccctttccattcccctggacaccaccctgctcctggcgctggttcctttgcatctggatctgcactctgcctctggatcgccctgttcccagtctctccttactgaaatctgccctatacaccacattgataatatcgttgttaaagcactattttactgtgtcattccttcgcttataaaccttcagtgccctttgccacctataagtccaaactcaggctggcttttcagatctttcataatatttccccacactacttagccaatcttatctcctactaacttctaaatgttaactctactcctgccaacttggtctcttcattgcttcccagatacgttgtctcacctgtatgcatttgtacatggcgtttgcattttctggaactccctccctaaatccttctatacatttttccaaaatatatcctccttccatgaagtattctgtaacccttctgatgaactcatcacttgcccttgttcttctaaacattccttacacacaaacaattcattttgacgttaccttgcacactcattgccagacgttgccacctgttttatatgtctgtcttctgaacaaaacaaattccctgttggcaaggacggtggtataaaccacctttgtatccttcaagaagcccaacacattgctgagtatattgcaggcctctaataaatgctttaaattgaaacgtggtaatgatgttttagaaagaatgagaatgaccatttgtgttttcttctctacctccagtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactatagtgtggtgacttatttaaatttttttaaaaaccttattctagggaatctgattcagacattttactttggcttaaaattcagtttcatttttgagtgcagagtttttgtattccaaaagaaacaaggggcaaaatttcatggagaccccacaccaaaaaccaaataccagcttgtcctgtttaagaaatagtgaattgaattgctttttttgtgacttgtcaaagttttgcctaaatcagaactttctaaactgtaaatggcagacctccaccttgaagtctatagcaaggttcttaagaagtaaggttactgaaggcattgtcattgccaagtgctaaggaagggtttgggtttttttgtgttaatgtattgtctgatcaggaaagtatcaggaatccttacagtagcaaagttaattcacctcgtgtcaaaagaagcataacagatttgcatatgcagtcagttgtataaacaaagacaacctattagtgttttgtcattttaatgttaacattggcagagttttcttataagagatatacttcctgaaccaaagaaatttccatttttcatgttatcaaaccacattgcaggtacttgtgagttttttttaatgtgctctttttttttcccacttggtttcattcaccaaatgtttgagtgcctgttttgtgccatgtaacctgttatgccttatgctttggagaaggagtgggggagagaagttgggcccaccttcgcagcctgaaatctcatgtgcatgtgaagattaggctactcattttgcaaagttaaacaggcttgtctgctgccaagaggaaaatatccagagcaagcttgtccaacccatggcccacgggctgcatgcggcccaggaaagctttgaatgtagctcaacacaaatttgtaaactttcttaaaacatgaggttttttttgcaattttttttttttttttagctcatcagctctcgttagtgttagtgtattttatgtgtggcctaagacagttcttccaatgtggcccagggaagcgaagagattaggcacccctgatttagagcctcactaaagtttcactcccaataacctgattctcttccattcagagctgaatcaacattgtgttggttacttggaaaggaatattgctgtaaggcaggactttgatctaaaaacttctcaaatccagctagcatatacataagccatattcatgtaaaaggcaccattcaagaagatggtggtgtcggggggagggggggtagttgttacaaccaccacatgtccagtgaaggagggaggtgttaggttaacatctggcttgctccccacctgctgtcatcctaccagctgcagagacagtttgttctcaactagcgtctgtggttcataagcagcatttactacgtgttttcagtatctgcatatctggcttccctgcataatgtaacattcaccttacttcagagggccaaatttatgcaaatcctagatcaagaacaagcatcaatacatttcttgctgtttcagaaagagctctttgaacctgacggacgctttcagctctaaagtgcccagattttactccaaggtagtctgcctttgttatgatacttagaggcagtttgctgtatatttcacatgaaaatacagttaactcttgaatggtcaaagactgattattgaggcccctaccttctctgactagactgtccatcccaaacccataattgtttttgcacattgtataacttgaacacttccacccagggctgaaggaattaggtgaaattccatggagtcaattttgctacctcttattagcactgataaaatgtgctaaagggaggatcatcttaaatctaaataacattatttcggtttgtccaaaatgaaaataaaactatggtctttagtcccatgaactctgacaatgtcagtttccacaaaatgggaaaagttgcatagaaatgatattaaaattaggcatctatatttccacagaaaatgttattgtggatgtgcaacatgctagccaatacatgtgataaatgaacaaagaatattcactatgataattttatttttaatatatctgacaaatatgtattctctaacaatgcaaatgagaaaagagatcagcaacattagtgcaaagcagcatactgtaagtaggaactttcccccaaaggtggacttatcagcatttatttaaaaatgactattttaaacaattttgcaacaagtaaaaataagtttatttgattcttattttcaaaattaccaggttacatggctttctacctgagaaatttaaacaaattgaaagcacattgacatatttttagtttttttgcataactaccaacaactcataagaaaaacatgaaaataccttaagacaaagtttaaagctcaggcccttaataggacatagaaaaagatatgagaaaacacttttgcaccacttagcacaacaaacaatagcagtgttaattaagaaggtggttacaatattttagttgtattttactccttactaagccattcaattaaaaagtacaggataagttatcttcctcatttagggcctacccaccaaaaaggttgactctttataagacatatacaagtctagggttatacaaaatgtaaacataaaaccagtatttttactttcttctaagtcccaggatggtatttagcaaaaaaaaaaaaaaaaaaaagacaaaaatgttatatagaaatagcaccggttctattacacataaaaattgcacatgctgtattctgcaatttatttttatgtctgactactgagcagcaaactgttttcatgtctaaaaactctgcaaagaaaaatcaagtgacagaacacagtgagatttttttcaaaagcatagctgcttctcattacaaactcataatattctttgttttaatggcatgacacatgaaaaattaagaggcaggttttcgtcaaagaaaaataatacctggttactgaaagttgcctgacaaaatacaagctgttagcagttcaaaaggctactctggacaacagtactttgaacattaacattcaaggcacttgccccataagcaatgtttttcagatttgacaagccaaatctagttttgatggaagagtcactggcttgaaagtggaattgaacacaagggagccaacaaatcatccactggttattatcttattaataataaacatcatctgctatggtacattcatttctgacttcttgcatgtactaacatagctctatgattagaagagatcgatgaaacaacttgtggctcttccttcagataaataagcttttgtagccctttcacatacccgtttgctcaaaaggctggttatatgcacacattgtgatattctgggcaaccacaatgactggcattctacctggctctatcagctggtacttttctacagaatgtcaaattaagagtgtttgaatgaatcatgtcacatcaaagtgttgccctttactgcttctgtggattaaaaatgactttttcctgttgctgacagtctctaatctcattaatgtcttcaattaccaggtcaggcatagttttgttggagaaaaaaaaggtaatcgattgcccctgaggtcctaaatgcaaggtaaggcagaatgaatcagcggagctttctataaaacatgcactgcactaagatgtaagtctttaagaatccataaaatatttcaatttaaaaacatttatgaagtcaaaaactagtaggtaaaaagatcaattgcttatgttgagagtttacaaatcctacacatatacatttttccctagctacaaaactataggcttttctctttactctttttgaaaacttgatggcatcactgaggattgagaagagaggcacttgttactgtttaataaagttcagtttgggggatattcagtgactttacaaactgatgtaatccagccctgagtgaaagggttacataacctgaagtggaatagtcacagcatcttttttcaagtgacatcattggtgccccacaatttttcaatatttccttttgcaaattccagtggttatattacttcaatcttgctgtttttctaaaatggaaagacatggggttcttaaaaaaaaaacaacaactctgctaatgggtttaaatactatccatttaaacctcaaaggacaatctggaccacttttagattcttcttccaagactttgtcttgaaaaagacaactctttgagtatttaaacatagtaataagattaattttctcctggtgggtgctcatgcaactctttaatgtcatgaagaagtctatgttctaactgtcgtctcttttatctacaattatttctaaataaaagtcaggaaagtttgttgctgcacgtggtgtttctgaccaaatcaaagaacatgtaaaaggatcattattcattcactgctgtcgtctttggagataaatgacactaaatgatgatgttatgacacctaaggagccatagagggccatctcaacccctctcaatgttaatctgctccttcactggcgtagaagtaaagttttagctgaaccatagaaatgtctatccttggatcaagcagcatttaaaagcttgagcagggtcaaatacaaattattatttctcttgccaaagttgaaagcataggtcaaaatgactccaggtgtattgacaagctttgggaaatataaaacacacaggttctgaagtttttaatgctgctgtcttcctgtgtagttgttaattacatggctacatttggttttaaattttcttcttgtaacatgtttattgtgaaaaaggatactcctgatctaagtggtcatcaaaacatttaaaatttaaagaaccagtgcagttatttcctgaatagcttccatagtcaatatactcctgaccattatgtctattatagtaataatcagaattgaacttcaaatagttataattacatcctctaaatcttgaattctggttatattctgacttccaaggagtccctcttcttccgtgaaaattaccaaaatagaaagacctagcacttcttgatgacattacgggcacctgagagggcccatagttcactttctggtccaatgtactatcactaaacctctttagataactggaactgggttcctggtagtagccttcatcaaacaagtatctgggggctagttgtcccttcatttgtccattgttgttttcatgtctaatgaaatgactttcacccctaggccatgaacatatccatctcggttcatactcagacttcctacctggtgtcctaaacttgtaattagagtatttttcctcaccatcacgcttccactttgaaaaaaaggtctgctgactcgaccttgtattttgtttgcgagtgatcattttgtcagtgtcaagaggttctttttctgagaaactattaaatgtggccacagatttctctttctcctctttgtttatactaagggtttcactgaagcattcagaatcactactaatttcctctaagaaatctgtcaactgtaaacctaagcctattgactcatggggtggggacacttggcttttccttgtggatttggaatcttcaatatgataactatgagtcttttccaacagacagctgtttccatcagttggggacagctgaccaccagctttatgggctgtctcctggcaatgagtttcaaacccattagtacattctttggcataatctacttttcctcgtttacgctcaggatcctgagtacaaatctttgatgagtaattattttcttgaacctgttctttcctttccaggttttctacttggctcgaattgattgagtgatgcctacactttctcaaattaatctgaaatccatctcccttagcttggacatccctctgccactgacatgtgcctgctacctgacttgtttctaggcagatacgagtatattgtggaggttcataataattgaaaagatagtcaaaaaatgcatctgtttcatggatcttaggtttcctgccttggcctctcccagataatctggaacaggattcactagaaccgtggtggtcttcattttcaagagactggccttcaattatcgtaatctccaaggagttatgcttaaaaaacaaactgtattcatattcctcatcatctaataatattccagctctctgttttctaggggaataccttaaattttcttccccaaggcagtgggaagatttctgtaagtgatccctagttgttttcttcattttttgtttttgtttattgtctgacttggcaacctgacattttgacatttcctcttgattttgaaggtacagagtgtttagctgttcttccagagttttcaatgtgttccctggagaatcattagctttggtgccaataatgtcgacttcctgtgggttaaactgtatggatcccttcaaagaaaaagattaaaaatctctcatgaaaaactaaacagattaaaaaattccaaagaaaaattgtgctttctgacattgttctgaagagacttccaatacctgggatagatccaaattaggaacaatattgcactgaggaaatagaaggcaaaattaaatgtcttagtctaatatgaactgttttgagtaggtctatgcccatgcttatgtgagaaggcaccacactttacatagccttcaaagcacatgactcttttttcacttgtttgaaaatcaataagcctgatgttccaggtattgtgctaggagctggagatacaaagaggaataagaaattatctatagccctcccagaaaaatcccagtacaagaaaagactgacaggtgaatcgtatatctaaaagggtccactagcttaaaagataaactgtctttcttttcataccagcctcttactgtggactgcaggtaaggctgtctccgagtttcctccccattcccctgtgctcagtaagaagcaaggtagcaagtagcaaatgtggccgtgatcgtggttctatctgcaatcatgtctgcagtgctatctgctctccataactgcacagcaggtgaaaggtgctgcccacaggccccaccctgctggaggctttgtactgtgctctcactgacacctgacacacatcagagcacagtgcctacacactacctgggattagaacctgggactgcataatgggtattagtatttacgaggccaagaatcagacaccacacacattgaaaaagatagattctttaggagtcaccctcagaggtcattaaggaaaatgaaaagagatccagctagccttattatcaataaaaatgtgacatttttctgatcctaatttcactaagtttgattgtccacactaatgagaaagaggtcaagattgcaaatatacataaaagtaactctgtgtaatcctaatggcatttactattcatattttaaaacactgaatatggatttttaaatgaacactttggtagcttttctggcttttaatccaggacatctgcagaatctggctatctttaggaggtcaggaagggggagaaacaccttccaaaaatgaaactctccaaacataacaattgctctgtgaggtgagaaatttcttatcaaatagtttaagactagattatcacgagcttgttacaaggctcaagactctaccaaacctactgcagatgagtggaaaagtaaagttaataacacctgacacccaccccccatccgtttcttccctctggcatttttctgttacatccattaggaacttagaaaagtagaagcattagctaaatgctctgggtaatactgtcctgaagtttagagacacaaagagagagagaatgagagagagaaagagagagagagtcaaatggaaggttgggacgcaactcctttagagaatgtggatatcccttttgtaaatctatcggattgttagaggtcagcctatttaaaataagccccagtggatgcaatgagtcttccatggagtgaattttcaataggccactgctcaaatgcaaaggtaatgtctcagaaaggtgagtacctaccaaacttgaagaacaattcggcaatagccttcctgaaattttcctcaggagtacccttaggaaccgaagtgcctcaactcacctctgagccactaggtacttcctctcctcccactcctctgaagagtctggctcttgaggtgcctcagctttggctttgggcttctgtttcctgtgccggtgtctgtctctttccttcagggcttgtctccttaccctggccttcttcctctttactcggactttttgctcatcatcttttctttttctggacaatgattaagattaaaccactcagaaggtatttattaggcatttgatttcctccctccctcccactgccaaggaagaacagatcatctcagcttccaggaatccaccactgttaaccccagtgcctaacatagacaattataataaaaaaacaaaacaaaacaaaacactgttaagcaccagtcaaggggaaagacacatcattttcttagtcaaatagaagctgtaaaggaggccttctgcagagatagagtatcaaataaagaaggctacagaattcaaaggaggggcctttagcccccacattctcaaaccacaagcagggatcacagaatccagctttcatggagactatttcatttttcttgtgaataaaacctatgagttggtttcaaacagacaaaggtgagtcaaaatactcagaaaatcttcagggtaagaactggtccttggtacatattacttaacacagcacactatcagaaaaacatactggcttagaagaatatgggctttttttctgctgttttctgaaaattaaaactgtcttggttaggcccttatgggaacgtggggaaagggaaagaagggacaattacctaagtcagaacttagccaaaactcagaggattatctaaattggatgtttagcctggatttgggggggactagttatatttactaggctcaagctctggccaagtttcacagacatgacctcaagtaattcctatcactccactagccaaaaaagtaagggacacatggaagggtattctttatctcctttttttttgagacagagtcttgctctgtcacccaggttagagtgcagtggcacgatcatagctcactgtagcctcagactcctgggcttaagtgattctcccgcctcaccctctcgagtagctgggactacaggcgtgtgccaccacgcctggctaatttttttttttttaatttttgtagagacagggtttccccgtg[134 bp omitted]ataaacatgcatgaggaagggccaggaagtaaaattaattttcaaagctctgtagttttggctcaactgtactcgactggcaacctttggcaatccaatagccccttctagactcaaactcctgaactggacgtcaacgataagctcaaagaaataaatacaaagaggccgagtgcggtggctcacacctgtaatcccagtattttgggaggccacagtgggcagatcacctgaggtcaggagttcgagaccagcctggccaacatggcgaacgagaaaaatactcccaatcaatccatgccttcttgcatacaagttagcttggttattgaacattttaagaagaaattccatcccagcactaaattcttaaaaattttaaattagtaggctaggtaattttgataatatttggtaaactggtaaaattcttaacttggcaggctaggattttcactataaaagtttcttgtccctttttaaaaaaatcatttctttccagacatcttaatctagctagttccatcattcctcattatttgtcctccctgacaaacatatttttttttgaagtctcttgttttcaacagttttgccattttggttttgtaacagcacagctgaaagactgtagctttcagtggcgttttccaatctgctccaattcttgccccccatctcaatgttatctaccaagtctggctgttcatccaaaaggattaatccataaatcaaagaaaaaaaatctttgttaaagttggtccacacacctttcagctacttcctcttctcttttcttttcttttttcctttcttcttctagttcttgtaattttagcctttcctgatttctcctccttatagctccttcgctgaagtgcttggtcgtatcagacgtaacctgctccaaaacaattcaaagtttcattagaaaagtttgccagctggctgggtacgtcccaggtcagagagataaaactaagatggtacatggtaattcaaaatcaattgaattcaaaacgtcctcactgcatcccagtattcatattcctactgcttctcagccaccagccaaacagtgctcgtaggcttgaggattttctttggcagaacccttgaataagtatatcaaatcatcaccttaactttacacaattttacttgtcagtcgtacctcaataaagctgtttaaaaaaaaaaaaaacctgaggagcttactttacatatggtcatagacaccatcacagtgccatcgtaggcacaggctgagaaatgtcaatatattacttctggttcgttaaaaagatcaaatgagctaatgtatttttttaatcatcagaaacaaaaataatcagaagtgtgtgtggtgcagggggagcaaagatgcacaaaaactaacctgatgagagagaagatctatcatgattagtaaacaacttttcaaatcttgaaataaagtgaaaattagattgagatactacagaatagtataaaataggttaaaatttttggttaaccaaatcacaagaaaattataaccagacactggacagcgggaagtggtctctcatcttgtggtaatgttttatttattatttatttatttatttatttttgtttatttgtttgttttttgagatagcttcttgctctatcgcccaggctggagtgcagtggcatgatcttggctcactgctacctctgcttcccggctcaagcgatcttccagcctcagcctcccaagtagctgggaccacaggcaagagccaccacacctggctcattttgtactttttgtagagatgaggttttgctatgttgtctcagagctcaaaatgatccgtctgcctcggcctcccaaagtgccaggattacaggtgcaagctaccgcacccagcctaattttttattttttaagctgagcagtggtacatgggtggtcatgacagtatttgctatatcatttgcctgactgaatagctcataatttaaaaatatacattttaacttagctagctacatatacacacatgcacatacacacatgcacacacacacacacacacacacacacacacacacactcatacactggaagcagaaagtccaaattcatgctaaagactgatttacagaaaaaggagagtttagttgcatcttttccactgctgggttaaaacttcaagaaggagatgacgaaagtatgtagacatcaatgagatgacatgatggagtagacaggctgattttgaaagtaaagaatccaagtttgttaggattatgtttagcagtttatctgagtctcactcttccatccaggcctgcgtgcagtggtgtaatctcggctcactgcaacctccacctcccaggttcaagcgattctcatgcctcagcctcccaagtagctgtgattaaaggtgtgtgccaccacgcctggctaatttttctatttttagtagagacagggttttgccgtgttggccaggccagtctcgaactcctgacctcaagcaatccacccgcctcagcctcccaaaatgctgggattacaggcgtgagccaccacacctggcctccatgtggtttcaaactgcatgtattcctctcttcctctctctcagcaacttgtcaaatataataagcatatgagataattccataggggccatgaagaattctttaatgccctcaagtagttgagacagaacctcagattataagaaccatcactttaaagtcatagctggcagcatgcctgatagcacaagaatgagtgttcaaatcaggatttttttcttcctaaacatccatttattaaaaataataaaagtctttatatattagttattgatcagagcctggtagggtctaagaaaatttattctagatgcttccttccagcttttattcaggatcacctgaacagtggaaaataaaagaaactctggctacttcttaccttaatgttacatgccagagctttcccatcatttcctttaagcatcagtttcattcttcaaagggactccatggcttttacaaagtcagttgcctcttgttactgtatgaatgcctcaaatgtctgtaagccaaagctaaaacccccaaagctcctgtcagtcatcacttctctgtaggggccaagcataaggatatccacattcttgatcttcccaaaactttcaaagactacccaaaggatctcttcatatggcttctctttgctagaacatttaggtgcaaaccatttacagggcaactcttcaaaacatatggaatctgggctcttctcctgctcttcagccccatcactcaacgagggctctttttccttggggaagtgctcccattctccctgggcatctgtagccactacttttaagtgttttttcaaaccatttagcttgataatcttcccatgtaactttgccttcaggatctgaaccaaacttcgggtttcagcctcaccctccaattgaatgaagtcctttgtactcttggagagctgaactgtggtgaactggtcagggcaaatcaggctcttcagctggtcaagaacttcccagttagagaagggccttacaggttctagactccctggaagcaatatgttgatcaacaattttgctatgggcttgaggtagaggtgctgagctgcacagagctctgttgcctcagagttatcatacaccactgtgactgtcatgttgtcctcagaccaccttagagaacgaaagagaaaattttgatacagatggagtaatacacagatttggattgtgaaatggtgctggcattgctggacttagaacaaattgataaggaaagctatactacaagcagaattaaaataatatcttctgattcccggaactaataagttatttcagcagggcttcagaatataaggttaatacaaaaaagacaatagccttcctatatagcagcaacgaacaagtagaacttgaaatttaaaactcaataccatttacattagcacacaaaacaatgagatacttagttagaaatctaacaaaatatgtacaagatctatacaaggaaaagaaaaactaaatatgtggtccacgaataagaagactcaagatgtcagttcttgccaacttgatcaatagattcaatgcaatcccaatcaaaatcccagtgagttattttgtagatattggcaaactgattctaaagtttatatggagaggcaaaagatccagaatagctaactcaatattgaagaagaacaaagttggagaactgacactatccaaaatcaagacttactataaagctatagtaatcaagataatggtttggtaaaagaaaagacgtatacatcaatagaacagaataaaaagcccagataggcccacataaatacagtcaactgatctttaaaaaagaggagcaaagacaatttaacagagcaaagatagccttttcaaaaaatggtgctggaacatttaaacatccacaagaccttgcgtattgcaatgactttttagatgtaacaccaaaggcacattctagaaaagaaataattgataagctggatttcattaaaatttaaaatttcttctctgcaaaacacactgtcaagagaataaaaagataagccacagaccggcagaaaatatttgcaaaagatatgtcagataaagaacggttatccaaaatatacaaagaactcttaaagctcaacaataagagtacagtctgatttaaaaatgggccaaagccctaacagacaccttccccaaagaagaaatatcagatagcaaaaaggcatatgaaaagatgcttcacatcatacgtcatcaggaaaatgcaaattaaaacaacagtgagataccaccacacacctattagaatggccaaaatccagaaccctgaccacaccaaatgaggtctccttaaggaagaagcatcacaatgagcatgtggtacaacagaaactctcattcattgctggtgggaatgcaaaatggtacagtcattacagaagacaatttggcagtttctcacaaaactaaacatacttttgccatatgatctagcgatgcgcactccttgttatttctccaaaggaactgaaaatttatgtccaaacaaaaacttgcatataatgtttatagcagctttattcataattgtcaaaacctggaaggaaccaagatgttcttcagtaggtgaatggataaataaactgtggtacatccagacaatggattattattcagccccaaaaagaaataagctatcaagccatgaaaatacgtggaagaaacttaagtgcatattcctaagtgaaagaagccaatctgaaaaggtgacatactatatgattcctattatataacattttggaaaagacaaaactatggaaacagtaaaaagatcagtggctgccatgaactagaggggagggaaggatgaataggctgagcacagaggatttttagggcagttggagctatgctgcatgatactgtaatgatggatacatgtcattatacatttgtccaaaaccacagaatgttcaacaccaagattgaaccctaatgtaaactatggactttgggttatgataatgtgtcaatgtaggttcactgattgtcacacctataaccactctggtgggagacgttaatcatggggaaagctgggcatgtgtaggagcaggagtatatgggacctctctaccttctgctcaatttttttcttttttctttttttttttttttttttttttttgttctgagagggagtctcgctctgtcgcctaggctggagtgcagtggcgtgatcttagctcactgcaacctccgcctcccaggttccagtgattctcctgcctcagcctcctgagtagcttggattacaggtgtgcaccaccacggccggctaattttgtgtttttagtagagacagggtttcaccatg[137 bp omitted]aaaataaagcctattaaaaataataatatctgttctataagggaataataataataatatgtaatatttacttaataatatttaatgttttttagagttttcaaagagtatatactgtgtctcagtttccttaaccataaaatagagataataagatttgggggagaattaaatgagtgtgtacaggtgaaatccttagaatgtgcctggcacacaggaagttctcaataaacataagttataatattatctattagtggtagtagtcttactttatctcatttgatttatgaagcaacccgtgagtaggtatttgcctgcctgttttacagatggggaaattcagacagtttcaggaaaattaaatgacttgcccatacattgagaagccaagattttctaaatctctaatctattgtacaattgatcttaaatgtaaagttccattaaaaatctgctggggatggtacacaaacagggcaagggtggcacattaatgaacatgcaccgaacatacatagaacttatagttctaacccatgcacctgacttagcatcccttgtccacgttggtttccaagtctaaaatggacatatctactcttgttcctccagtctgttgactttaactaaattgatctctaagttaaagttaagaagagacagccttttctaatgagtgacaaagtgaatttgccctctacttggggactggaaaaaccccaaaacatgagtgcttcctgtttacttcatattaacaaactctttgaagcagtactaaggtgaacaagatcactaatgctgggaattagagatttaagcttctatttgcttactttaaatagcacttcctaataaaggagtttttttctgagcagatatattcagactctatgtcaccagaatttctcattaacgtcaactttagggaaatttagagccaaacatatatggccagatgacagaaattctaacacaaaatttactgcgaaatcttggctaactttataggtacagaattatttaataactacccttaaaggacaatccaagttaacttcctttagaaggcaaggtttgtagagactgattttataaaaggtcatcaaaagcagtatctaagatactatgttctagaaacccttatgacagcaacactgaaatgggatgatatgagaagaaacatgttttctttctccaaaagcattatctatgtagcaaaatggaaaaaatccagttagtttgctgcaatttgcaataagagtcaacactaagccccctctaggagaaaaattaatgtgatattcaattaagatatactgaactctaaaatttatttataaccattaggtatttatttatacaacctaatataaagcaatagtttttttaaaaaaattccagaaaatattcacccaaaacagaattactctcttcaaagtaatcaggtttgtcaagctctccacttgctccagcaatactgcctttgtttaaaacactgtagaatgcttctcttggattgatttcaaagcctgggttacattattttaagtagcttcatggaggccaatttctaaattcctttatcatggatttgatatttagaaattatcacaaattatgtataatcaagaatgttggataaaatggatgactataagaacaaactgattttcccaagaagacccaattgtttttgaaaaaaaaaaaaacaaaaaactgacctcctttaaaatcctcacaacttaaattcctgtttcccaaggacaaaaatgacaagaaactgaggcatttgttcttctcatatctttcatagtggttcacaggctttagatcttaaaattgaatgtcaataaatatttcatcttaaattactctcccaaaatagagggctaattctctaatcttacttttaaaaaatattgaggacctagtatgaccaagaagtaagctttttatatacggcatggcttcattgctatagaagtgtcattggcaacttcttctaagtcattaaaaattaactagcatagtgactggtacataggtgcacaacaaccaactcccattgtgatgcttcttccttaaggagacctcaagtcaaaagctaataaaatatataggagaagaaggaggaggaagaggaggaggagaaggaagggaacagagggagggagtaattttatttttggatatttagtgagtacaagtgcagatttcttacatgcatatattgtgcagtggtgaaatctgggcttttagtgcacccatcacctgaatagtgcacattgtacccaaagggtaatttttcaatcctcacctccctcccacccttccaccttttggaggtagggagggaggtagggagccagacagtggatctgtatttactgacaaaaaaggatgcctgtgatagtttttagggaaaaaataaaaagcaagtgacagaataataaagtaacatatgatattgctcttataaaagtaatataaacacacatggccatgcacacagacataatatataatgtctggaagaatatacatcaaattgttaacaatatttcccctagaaaatggattgggactataggagaagaataaactttccctttttattaaatactttgtacatttcctttttaaaaatttatttttatatatttagagagtacaagtgcaatttcttacatgcatgtattgtgcagtggtgaaatctgggcttttagtgcacccatcacctgaatagtgtacattgtacccagtgggtaatttttcaatcctcacctccctcccaccctcccagcttttggagtctccaatctattattttactctatatgcccatgttgtacatttcttaatgcttcagttttttaatgtttacaataagaatgtattaattttgtactttgtttaactaaaaagaggaacttcagatgataataacaagctactaaaaggaagcaatttataaccgctgacaccaacttgtccagaaaagggtaaaaaaaacagattaatacaatagcaactcccttcacccaccaaaagcacccctctgtctgccatctctgtaaatgcctataggcatttgaacccatagtcaaagtttgtgtgagtcacgatggaagcctgggagatcagaacaggactttgaatatcacaggctcacttggcaattgcaatactagctacacaatgggctgcagaacctatcttttagaactgctttattgaggcaaaattaatatataataaactacagatttcataacataaactacacatgtatcaaaactgtatgttttgataaattttgacatatgtatacacacctatgaaactatcactgcaatcaaggtagtcaaaatacccattgtccctccacatttcctccctaccctcatcaatcactgatctagctgcaaaatattttgttttgagacaggggtttgttctgtcccccaggctagactgtagttgtgcaatcaaggctcactgcagcctcgacttcctgggcgttaagccatcctcccacctcagccttctgagtagctggaactacaggcacgtgccaccacgtctagctaattttttattttttgtagagatgggtctccctatgttgctgaggctggtctcaaactcctgggttgaagcaatcctctcacctctctctcctcagcttcccaaagtgctggaattacaggcgtgaaccaccactcctggcttagctgcagcgtttaactcataaatgataatttataacacagcaaaagcaaacagatgtttttggaaaatactcaactagtccaggcatggtggctcacgcctgtaatcctggcactttgggaggct[135 bp omitted]gaggcaggagaatcacttgaacctgggagg[132 bp omitted]ccaaatacacaaaaacataatctatgcttagttattatactgtagatatagttatgtattttatgcatatttatatattcatcaaaatatacataccaaaatgtgtggaatcactaagatcaaattattaggctttgacttaaaactgactctttagaacaacttaatttgtctctaatttcccttttaattagcctgtgcttcaattgaccgtaatggtagaattcattaataactttcccatcattttcaccaatcactattatatgcatagattaatttattaaacaaagtttcaggagcctagataaaccaagccttaatggcaagaaatgccataatcatgaccttcacaaattatcaaaaagtcaaattttaataaatatttctagtattcccatattctattgtgttcaccataacctccccaatcctccccacccacatgcacatatctttcctttagccttatgattaaaagcaacactactgagatgacttattctttaatatctttgcataggaaaatgggagctcctctaaccttaaaaaattatagttatttaataatgtttacacagtgtgcattctagcagtatcttgtgtacgtagcttcactaaaacatttcactcaacatgttcccaatgccaaaacatttctaggagattctcagagaacacggtcacctcatcttccttgcctctatatctcgtagcaaagttgattgaataacagtaggataagggaatagagaaaaggaaatagactggagatgttgtcacaagcctaaaatgtttattttaaccagcagtgaaacctcagtaaattctgcacagtctgcatcctaagacattccaatatcttctcctgtttcaggagatactggagagattcacctaatatatctcaggatttttagatcagaaatataacttgaaactttaaaagcacttgagtaatcagcaaagtagccacctattcattctctcttgcttgttctcactctcataaatatttgctgtcatagtattagaaaggccatttgaatgaggtacttaaaaaaaaagtggaaaaaataggaccatctatgcaatcaatatcctctttcaaagtagctctttgctgcctttcttttttctccaggcttttgaattttaaggttagtcattttgaaaacatttaagatgtatgcaattatacaacatatttatggaaatagcagggaagccagaatttatttgggtcaaattaacctagccaattttcaattttctggctactacagaatcccagtatatcttgaccaaataaaaacattccatggttcttcagtcaagatgccacgcatggacgttcaagtattctgacacgccattagcccaacaacattttaaaactgaggctgaccatatgctctgatcttgaataatttaaaaatcacatcattaaaatgagtggcactcagttttgcaataataagaatatagccaatatatggcccgacaaatgaccgaattccaaaattaaaatggtctgggcttatgggggcactgggggctttctgggcagaatggaagggatttttggagatgcacagccatttggcaatgataaatttgcaacaatgaaatattagagtcctactgagagagaatctcttctaccaccattcaaagaaaatcagctcgaaggtagaatttagtatgtggaattttgatcctgagatgaagaaagctggattcacattaatttaactctgagcaacttaatttcctgttttcttttccttgtgttaaaacatcatcctaaagtttccgtatgtggtaatgtttgtggaagcaaagtgttctgagtgtttctgaggctaatagaaaataaattagcctgaagaaaagtcttgtgttggcctttctgtgcaaatgcattcacataactaactctaagctagtgtgtataggagtcattccaagataacaagggaagaagctatttttaaaaacctgcacagagcagtcagcagacctatctgaccagtcctttggtcttttgccccttcttctgcaccaggaacatttttattgaagaacacctctctccagacacctccagccaggaatgctgctttataccttggattaataaacaatgctactgaagaagactcactgctttctcttctcatgaaaaaaaaaaaaagctatcagggaattaaaggaatgtggctgagtatcttccatacttttgcctccatcattgaataatcagtattatttgtgggaaatgcgtatcatgaggttgccagtgttttgcttctcagttgtatttccacaatctgaaaattaccagcaaaattcctgcccaccagtcgccacctacaggtcaaaagcaaccttcacacgggaccctgctttgcactattacacagtttttgagagtaacagtacttcccaaccttttaaaaatcccaaggtaaacttatttgaatacaagtcccacagaataggatattatccaatacctcgtgctgaaaatgtgatcaagggaagaaagactggagaagccacaattcacttgaactcttcacagtggaccaaaatgaagttatggcatcctaaccagggaatagtgccagagagaaaaaggtacaaagtcaaaagcgaatgaaattattttaaaattaagacaactgtatattaacaatattcagcatgaacagcatgtaagatttacaccattgtatataccatcatgatctgatttttgcacctgttttattagcaattccagatattgatatggtcaacacaattcctcatttttcatgcctatagagagtttctctcgaaattctgtacaattacaatgtgtcaataaaaattaaatgttgttaaaaaagaaattctatatagagaaaaattctatagaaactctatacttactatatatttagttggatattctccctggggatttgtgtcttcaattatttttgaaagagcataactctttccaaaagagtactgccactactctacactactattatgagaacaagtgctaccatggaaatctttgtgtaaatttatttatttatttatttatttatttatttatttatttatttattttgtgacagagtctcactctgtttcacaggctggagtgcaggggcatgatctcagctcactgcagcctctgcctcccgggttcaggtgattctcatgcctcagtctccagagtagctgggattacaggcacatgccaccacgctcgggtaatttttgtatttttttggtggagatgaggtttcgccatgttggccaggcttgtctcgaactcctgacttcaagtgattcgcccgccttggcctcccaaagtgctgggattacaggtgtgaaccaccgttccaggtcttatgtaaatattttttaaaagccaatttattaggccatcagcattattaacatacttgattcccctgcagtcctgatcacactggatcattatcatttttatttctgttacctttattagtataaaatgacaacttaaagcagctttaatttgcatttaattttatgtaggctgtagttccagccaacttttatattgatattcaactgcctattcaatgtctccagttgaatgtatcattggcatctcaacctaacaagtgcatcagagcccttaatttgcatctcctaaacctgtcctccacatcacacttgctcccctgattcccagtgattcccagctccctaagtagagccaccctgcacccaggcgcttaggctcaaaacctaggagttaatccttccaaaagtctttttgactccacctttaccacaaatcccaaattcatctccatcttcgctgctaccccccagtccaggccactgtgatctctcacctggattactgcaacagcctcctaactggtccttcttcttccatccttgcccctacagagtctactctacacaacagccaatgtcatatttttaaaaacctaaatcagatcatgtcactcctctgttcaaaaccctccagcagcatctcatcatgttttgaatgaaatccaaactacttaccttcaaaacatggcccccgcccacctctttcaactcagctttttacccttctccctattacccttgttctctccatctcaccccactggcctttttactgcccctcaaatgcatcaggttcactcctcaggcctttgctcttgtggttccctctacctgaagggttctccttcaagattttctcatggctggctccttcactttgctctcatttgacttgaatgtcacctcctcagagaagcctgccctaaacactctctgaaatagcactgctatcacccctgtgacttggtagcctatcataccattttattttcactgtaacacagaaaccatctgatcatcctgtgtcattgttaacattttatttttaatctgcatctgtctggttcaccattatatctttagagcctagaacagtacctaacatatagtaggaacttaataatgctaaatcttatgtaaaacagagactttgtg[211 bp omitted]gaggcaggagaattacttgaacccaggaggcagaggttgcagtgagccaagatcgcaccactgcactccagcatgggtgacagactgagactctgtctcaaaaaaaaaaaagtattacttccctacttaaaatactaataacagcacctaaagacccacagtgaaatgataatgcagacttgcttgttcttttggactcctagacctattaacattaatcagtgaacattgagattaatttaagtgtacctaccaagcacctttaagacagtttggggaccacagtgaagagtcaccctcaaacaactgagtctagaaagggaaagaaattgagacaattaactggaatctaaggaagaaaatggtgaatgtcaggagagacatttggtactttgggctacagacaagcaataatggttttaacattctttcacatgagtgttaaaattcctgagaataggctacagtcatgtttaagtgtgtcagtattgctcccttcaagagtgttgggacatgcataaaaatagttgtagctgtcacaataactagcatagggaggacaccactgccattttgtaagcaaggggccagcgatgctaactgccctgaagttcctaaacagacctgcacaacaaagaactccgcacctcaaatgccaacacagagtggcttatacctgcccatctaaaacgtatggaccactttctgggactccagattaatatttttaacatgctatcttttaggtagtcacttcggggttttttcccccccccgcaattttttttaaatctttttgacccagatcctatacacatcaactattcagcaaacagaaaacctgagtgcaagcaaaggatgaagaacagcaaggcccaccagaatgtctctttggggccctagcacagcgggctttcagccccaggcccaaagaaagctactatctatggataatgctccacaatgaggtacacagcattcctgtgtgttaagattattcacccttcacagagacagtttcactgcatgtctgacaatttcctaattacacaataagacaagaagctaatcctgagtgtgaaacttcccaagtgggggcttgtttcccttgagcagtggcccagggcctacaggattaggcaggtactaagcacgggggctggggactgggtaggaccatgggaaagcagagcacctgccccttgctaaagaagtcagttctgcacagctttgccctccacaagtgaaatgcagaccagaccttccagcatttcaagataagctggaaatcctgatccttactgagttcttttgctttttcaacattgaccactaattcaattgctttttcaaatcctgtgcaggccgcagcacactcatctaaggctgagtttgacccagggcccctagcgtgttccttctgcacactggacccaggaatgtatttggttgcacatgtctgctactctgtaggggttcaggaaatccaaaaacaatgtctaaatgtgctaccattgggtaaggttctcaagaatgagaaatgagaatgaggatgagagaggcacatgctggtcacaccaggtgactgatactgcctttgccatgctcttccttgccccaaaattctcaacatcccccacttcttactgcttcaggtaacagtttcccttcaaaggtctccaaaacatgatcctacccaccttgccagccctattttcaccacacccgtgtgtccatcccccattctagttgggccagtcttccttgagttcctttaaagatgttgatcccctcagccaaatatcccatctcctcatctaaagcctactcacccttcaaaaccttgctccatttcacctcttttatgcaaccttctctgtgacagtaaaaaccaaaatgcttttgagctccaggtctggtgtcaagcagatctgggttcaaatcccgcctctgccactgaccagcttggtgacatccttgggcatgctacctaacctctttgagcttcagaagatgataa[136 bp omitted]catggtgaaaccccatctctaccaacaacacaaaaattagcagggtgtagtggcgtgcacctttaatcccagctactcgggaggctgaggcaggagaatcatttgaacccaggagatggaggctgcagtaagccgagatcatgcactgcactccagcctgggtaacaagagtgaaactctgtctcaaaataaataaattaattaaaatgatccaagtaaagtacttaacttccagtaagtgttcagtaaattttcattattattatgactaccaaattttcactgaccttcctcttcttctgcaagtgctccagcccttgcgctgtctcttctgagcaaagggcaactagattccatgatgtccacatttgctctgtgccccaggcattagcctgcctcagcccacagcttggttttatagcttcttaaagtgccagaagcatgttggatacaacatagaacccacagacccaagtgtacactgaatcagagagttggacaactaccagcgccctggctctgaaataactcagcaaaagtctctctctctctagcaaaggtaggaatgcatgctgggaagataaactgcttcactgtttggaataagtctctctctcacacacgcatcaccaccaccaccaccaccaccaccaccaccaccattatcatctccatgttctctaacctctgtacctcgcctttcttactgtgggtagagatgacacataaagccagcaaaggccactctcttcacgtaagtgtatgatgggaacttggacaaacaggctgcactgcaggtatactctttggctggaacaaaatggaaagccactacaaaagccaaggtggactctgcaggccctgtccccctcctgcccaatgttactccacctcaagtcagccccatccatcctgatgtgtgtggcagctgggatcctccgggcacctttgccagcaggcctattccactagtcactttcctctgtgctccacaagggttgaaggaaaaatcccttcatggaagttactccatgcttcaagttactccattctttgaaggcctcccccagcctctctcccctccccccgcctctctcccctcctcccaaaaaaccagagcacagaaaaatgtaactgctggaatgtcacatgcttcaaaaggcaaacaaacaaaaaaccagaatttgagaggtcccaacatatttttccaaaaaatggttttcttagcatgaagaacgagccctaccgattgcactgcacaagtttacactctcaacagcatgaagttccaaggttagatcagacataggccggaaaacagggcgaaatgggcatgatctttgagatcatattctcaatctagaaaagacaccaagaagaggcccaaagggtaaccagtttcccatactggaacccagcgttccaatacacgtttgttacccctcggagttagcagcactagaaagttctgcctcctgtaatggtcgactttaaataaaaacacaaaaagcaggagaccaaaaggcggcacgggtcccaaggaccacgactatgatttcccctgagtgcgggtatggcatgcatatcctacagcatgggcctccccaacttgattcttcccctcgcctctcggcccaccaacccaagctcaggatcttgcatcccgaaagcgttgtgggtgagcaagccacagtcagattaaaacggtcttaatccaccccgccggaaacctcaagccgagactcagaatctcttgagaagtccctaaagccaaggacgagggtcatcagggggcggcagcggcagagccctgctaatgatgggcacttggcgtaccggtcgagcaggagagggcaccttcagttcccattagcgggatgtcactgccaacgtgcctcaggggaatgcctcgaccttcgcccaacagcggcctgggtgagccctcgagtgggttccggtgcgctccctggctcagcggggtctcgagtgaggggagagtggacctggaagagcctaggcgttactctggaaaacgtgactctgctggggcaagcggggaactcgggtctcttgcgcagcccctccccagtccctaccgaaggcccagcgtggctgcctcctctgaggacagagccgagggcatttaccgggagcttcaggaaccgttcgtctctactccaggatccggtaggataacgggactgccgccgccgtccctgccgctgccgccaacgtctatgccgccgtcgtcgcctccctctaaccgccgcagtcgcaaccgtcagcggtcccagtcaccccgtgcgactgtcgctcgcgaggccagctgttgaatggctcgcgtcgagctcaccgcgcgcagaagcgtcctcgctaagagggcaacgctggcgcgcgacccggtgccaacgccccgtgacctcctcgatcccctgaggctctggcgagctcaccgcggctgcctagtagctcgcgactgcgggttcgtctgcccgcgcgcgggctgccctcagagctctgccgccctggcggctcgccctgaacttgcaggcaagaccagtggcaatgatggactcttcccgccccctgattcccccagggccaatcgccttctcctgaggagcccttcaagtaaccccgcccctctcctgctgcaaaggccgagccaaagtttaccccaaggcgccgctactcccgaagatttcgaggctttgatcatgctactcccccgtcaacccctacgaagttacagtgatttagaggctgaaactcacttggcctactaacccccacgcgacctatttcctttgaaaaaacgagtatacaactaacgagagaggtgatgttgttcacctcatccctgaagtgggactgctgagaagtggccacgcgctcggccaaatttacacatcagggagtgaggaagaaccacaaaggccatcgactgactatcctcgcattgtttttttctgtttctggggcctgctttcggaggctggccaacttccagcgaccaggactcactggctccgtgtaccaccgttcgggtctccgacttcctggcttgagagtgagcgaaaccggtcccctggtaacttctgcacgtttgaggacatgcaaagtcagtcttgttcctcctgcccatggtggtccaacaatttgaacacaattccagccacgttcctccaggctctgttgctctaaagacctgggttcaaggctcgtctctgaatttaattcctttatatcttttgaaagtggaaggcaggaactgagtctatcctttacaccccaccccaccccagagtatagacccttcagcacagaggagaccaggatggccaagtcccttatatagacttctctggtggagctccctcaggtagcattcactttcttgacttccatatcacaaggcccattctatagaatatagttttaatatataattaaaactacagaatatagcttaatatagttataatattttgaatatttttatgcttcaaaataaaatcaaatataaccatattttgtatcatttaatctcttaagttatattccatccaatataaaacaaatctgtgtacactgatgcagtatacataatcatttcagttaaataaattgacctgaaaatttaatagctattccttattgtgttaggtaccatgaaaagggttttacatatacaaactgtataaaggtatttagtactaattaaaaaactgtgaccgaaattccattttttgtccccattttttaaatgaagaaaccgaggcatagaaagtttaagctacagccctacatgagcgattaaataacgagagctgagattctaatctgagcaatttagttctagatgctatgctgctgatcattacgttgatttgtattttaggttatccaatgctccaaatgggatatattaaagtaataacaatgggaaaattgcttctcttgtcatctaaagctttttgttgttgttgttgaatcttaatgattttgtgctttaattactttagtgaaatattttcttttctaatgcatagactattggggaaaagtaaaacagaattcagcttatcaataaatgatattcctgttagtgtatttccgggacttttgtttcaaacaatatacatgaagaatgcatgccattcatttcattttggggcataagcaacaacaattaaaaataaaaacaaaaatagaaataataccaagaaaactgacttgaaaacctattactaccaatgtctgggaaaaaaaatcatggttcaaaatctagttattcccacttattagctttataacacagcttgggcaagtgacttaattttctaggccactattttttcatttgcacaatgagaataattctttgcaatgtcgttttgaacattggtatttggaacacctaacccagagactggcacattgtgagcatttaataaatgtcagtgacataatgcttcaatctcatcttttaatgaaaaggctttcctggagtgagaccaaacccttgaatataccagttacaagaagagattatcagaaaaattagtctttttttaaagatttgcacaaaatatttagcaacagaactaccctgttatgctatcatttgatatatattttcaaaatataatgtcactctaagtgacataatcagtaaacatagcacagataaacctaaaaaaattcctaatcctagttgttactcttataataatcctttattacttaaattataattagaaaagccttaacaaaactaaaattcttaaaacatctacattttaatgtaagttaaatacatcataagtgtaagacaccattaaaatttagaaaaataaaacctaaagagcagtaagcaatatggcttagaattccctctagcattgcaaaataaaaataaaaggggcttaagcagtttcttttatttgatgtggctttctcttgaagaatataaatttgatagcagatacccaattatcttattaaggtccatatccatacacagggcagaaaattatcattaattttcaaccgaagtgacaacagaatccaaatattagaaagaaaacaaatttttaacttttgctgccataaatcctttataacccccaatcagtaatgcctgtttactatcaagttttaaggtgaataaaaaaaatccaagcagattattcaagtgttcaataatttgaaatgctgccattctattctagacctttggaaatcaacgtgagaaatgaatcaggttgcaagggattcacctactgtaagcttccttctgagtctggacaaaataagagttatgttatgtagcattggaaaagtgtcatgtagcattgatttactatgttactgatagcactgaaaaaaaaatcaacttaccttacccgagaaacagcaaaaagtgcagtctccaaatgttgtactttggttttttgttagtttgtttgtttgtttatttttgagacacagtatagcttagtcacccaggctggagtgtagtggtgcgatctcagctcactgcaacctccgcctcccaagttcaagcaattctcctgtctcagcctcctgagtagctgggattacaggccaccatgcccagctaatttctttctttcttttttttttttttttttttttttttagtagagacagggcttcaccatgttggccaggctggtctcaaactcctggtctcaagtggttcgcatgccttggcctcccaaagtgctggggttacaggcatgagacactgtgcctggcctgttgtcttttggataaaatcattagccgtgggtacaacctgaaagcacagagttgtattgaaaggcagccatgaagcccactcaattcatttgactctcttgcctgttaaaactatttgtggaaatttctgcccagcgtggtggctcactcccagcactttgggagaccgaagtgggcggatcacttgaggtcaggagttcgagaccagcctggccaccatggcgaaaccctgtctctaccaaaaaatacaaaaattagccaggcattgtggcacatgcttgtggtcccagctactcgggtggtctcagctactcaggaggctgaggcaggagaatcacttgaacccaggaggcagaggttgcagtgaactgagatcatgcccctgcctcactctggatgacagagtgagaatctatctcattaaaaaaaaaaaaaaaaggccaggcgcggtggttcacacctgtaataccagcactttgggaggccgaggtggatagatcacttgaggtcaggagttggacaccagcctggccaacatggtgaaactccgtctctactaaaaaacacaaaaattagtcaggcatggtggcacgcgcctgtaattccagctactcgggaggctgaggcaggagaatcacttgaacccaggaggtgggggttgcagtgaacccagatcgcgtgactgcactacagcctgagcgacagagcaagattccgtctcagaaaaaaacaaaagaaaagaaaagacttttgtggaaattttagtttactttaatatatttatgtcactgtggaatgtaactctgttacctttatatttaaaaattggttgaatcaatgaatatagcagaaactagtagaaaatgtattattttgaaacaaggcagctcatttatttgagctttcaattcttttggatatatacccacaagtgaaattgctggatcatatgatagctctgggggtttttgtgtgtgtgttttgttgttgttgttgttgtttgtttgcttgttggaaacctccatactgttttctatggcagttgtactatttttacattcccctaacagtacacaaaagttctaatttctccacatccctgccaatgcttattttctgtttatttttatagcagccattctaatcaacgtaaggtgatttgttccttatttttagcccaggtatatacccaattatcttacacagtgtttcatagtatgaaaaatccactatcaataaacaatttgtttgagcctgatcttcagttatttcaaacaatactgcagtgaacatccatgtatgaatatctttatatatatgttggataccttttgaaagataattgtgaggacaaaggatatgtatatttttgtagctttttattgtgatataatttcagacttacagagaagttgcaggaacacacgtatttccccaattgttaacagtttgtcggtttgttttatcatattttctctatatatgcatattaccttttttctgaaccatgtgggagtaaattttagctatgaggtccatttaactttaaatacttcagtatgtatttcttagaacaaaatatttctctttctgtcctagatgcatttatgaaaaaagaaaaaaatctcttttttttttttttttcctttgagacagagtttcactcttgttgcccaggctggagttcaagggcgcaatctcagctcaccacaacctctgcctcccaggttcaagtgattctcttgcctcaatctcccgagtagctgggattacagggatgtgccaccatgaccagctaattttgtatttttagtacagacggggtttctccatgttggtcaggctggtctcgaactcccgacctcaggtgatcctcccacctcggcctcccaaagtgttgggattataggcgtgagccactgtgtccggccgaaaaaatctccttacataagcacagtgcaaatattaacatcaggaagttaatatcataaagttctattatctaccctacaggccttactcataatactccaattgtgcagataatgttctttgtagcaaaaaaattggggggagggggtctgagatgtaattcagcatcatatattgcatttttcatttatatctagccttctttcatcttgaaactgttcttcagactgtctttgactttcatgattatggcattcttttcattatttttaaattactactactactattattatcattttaaaccaatcctaaacttatagaaaagttggaagtgtaatacaggttgttctggtttttttttcctgaaccctttgaaagtgatttgccaccccaatgtcccatttcccctgaataatttagtgtgtacctttttatatttttaatgacaaggatactttcctgtctaaccatgaatgaatcaaccatcaaaaatcaggaaattaacattaatagattactaacattgaatccccaggtactatttaagtttcatcagatgtctcaaaatggtctattacagcaaaaggatccagttcagaatcgtgcagtgcttttaattgtcatgtgtccttcatctccttcagtctggaagagttccttggtcttctgttgacttttaagactcaggcacttttggagactatgggccagttaatttgggaaatatccctcaatttgagtttacctgatgtttcccaatgattaaatttaggttacttatttttggcagggctatcacagaagtgacgctaggctctaattgcattctgtcaagtggagcataatttcaacgtgtcctattactactcatgatggtcattttgatctcttgactaaggtggtaagtgctaggcttctccactgtgaagttattctttgtaattagtacataccttctggggaagtacgttgaaactgtgtaaatattccattcctcatcaaactttcaatttattcatttatttgtttataccagtatagacttacggtttcctattttattcaatggattatagtccattattatcattgtttactttgatgctcaaattgtcctagatttggccactgggagcccctttaagctggtttccatgtccctttgacatgaccccatcatttttcgagcacctccttagtttctggcacaaaatattccaggctcatcttgtactttgccttctgtagtcccaaaatcagcctggagaagccctgattccttttagtggaaatggtatctagaagccaaatctgagcagcaggtgtatatattgttgttggtgtgttgctgctccctgagcctctcagagtcctcacttatatacacttacacacacacacacatttttatctatctatctatccatctgtcatttatctaaccatgagtttactctgatatatccaatccaacaccacagggttcattctaattttctttctttctgcattagtaataatttatgacaatgagaagatagcttacatcattcttaatatatttactcatttttatcaatactcctctatgtaactgtgccgggaggtttctaagatagccctcggtgatccctgcctcctggtattcaaccacttgtggaatcacctcccctggagtgtgagttggatttagtgaatcacttctaatgacagaatacagcaaaagttatgggatgttacttccgagattaggttataagatgactctggcttctagtctctctcttcctccctccccttgccctacccactcctccctttctctctctctctccccctcccatcctccctctcagtagctgagggaagctagatgcccttatggagagacccacatggcaaggagctgagagagccttctggccacagccattgagcaactgaggtcttcagtcaacgccccttgaagaaataaatcctaccaacaaccacatgagtgtgcttggaagcagagcctccctcagttgaagcttcagattttagctttgtgagagactctgagccagagacacccagctaagccatgcccagattcctgccacataaaaactgagataatagatgtgtattgtgttaagctgctgagttttgggggtaaattgtcacacagaaaaagatactaacacttggctgggtgcggtggctcatgcctgtaatcctaacactttgggaggccgaggcaggtggatcacttgagctcaggagtttgagaccagcctgggtaacatggtgaaaccctgtctctaccaaaaatacaataattagccgggcatggtggtgtgtgcctgtggtcccagctactcaggagggtgaggtgggaggatcgcttgagtctgggaggcagaagatgcactgagccgagatcatcataccactgcactccagcctgggtgacagagactccatctcagaaaaaaaatttaaaaaaaagcaaagaaataaatactgaaaaagtaatcaatctcccatgtccattgccacccctccctgacagctctgttctccctgcctgggtgcctctgattctccataaccagcctccctgcctcatggattccctctgcagcctgctcagactctggctccctacatcacctctcccccatgtgtatgacctcctcgttccactcaggctccaacagcccatgccatgccactccatcatgcggatgtccttgttagccctctgaggctctgacttcccacaccaggctgcccctccacagggatgccttcaccaacttgcttgactctgatccctcatagcagcctgtcttctacacacaaaccccttgccaaattgccctccaaaaatcttgtatcaatttacacttagtttatctctgtctgcctctccttttttttctttttcttttctttcttttttttttttttttttttgagaccgagtcttgctctgtctcccaggctggagtgcagtggcacaatctcagctcactacaacctccgcctcacgggttcaagcaattctcccgcctcagcctcccaagtaggtgggattacaggcatgcaccagcacgcctggctaattttcgtatttttagtagagacggggtttcaccatattggccaagctgctttcgaactcctgacctcaggtgatccgcccgcctcagcctcccaaagtgctgggattacaggcatgagccaccgtgcccggcctccctctccattttctttcttctctcacagggtgctggttggcttttccttcactgtttctaggtttcctcccaatgaaatgtcaaatggtccaattcttcttaaaaaaaaatcggcccggggcagtggctcacgcctataatctcagcacttcgggaggccgaggtgggtggattacctgaggtcaggagttcgagaccagcctggccaacgtggtgaaacctcatctctactaaaaatacaaaaaaaaaaaaaaaaaaaacccggctgtggtggcgggcacctgtaatcccagctcctcaggaggctgaggctggagaattacttgaagccgggaggcagaggttgcagtgagctgagattgcgccattgcactccagcctaggtgacaagagcaaaactccatctcaaataaataaataaataaataaataaataaataaacaaacaaacaaacagttgggtttatctgaactggcatatctaaatagggagcatttccaccttcaaaatgcaaatcttctctttcactctcactgacagttagggacttatatccttggtcagtgagttgtaatatagagaactataaagaggaaaaaaaggaagtatttataggaatatgctttccaacagcttgtgacaaggatgggcatttaaactgtagacatacaggaacttttccaaaaagggttcctttgctctttgttaagttccagatgcataaaaatctaactgagaaggggtcatttctttcttagcccattttttagctttcaggttacagtatgtggtcatacgtgtatttattctacctggagctcaagctagtctggctttatgtctctctgtcccttagggtaatatttatacttaacgtttataaggtactttatgtgactctcttaattcatccagtccatataatagcattaggagtttgctatttctgcccctgtttaacatatgagggaaaactgaacccctaaaagggggcgatttacccaaggtcacatagccagttagtaacaaaactggggctgaaactcaagtcttctgactccagccccaagaatctttttttttttggagacagaatctctctgtcatttaggctggagtacagtggcacgatctcagctcactgcaacccccacctcccaggttcaagagattctcctgcctcagcctccaagtagctgggattacaggtggtacctgccaccacgcccagttaatttttatatttttagtagagacagggt[135 bp omitted]tctctgggttcttctctttcaaagaagtattcttgaaagcttaagttccccttccaagttggagcctgaatatattgaaacccctgcccaagctgcctggtagactatatttagccaggccaaatcagctctttagaagtgaattgtgcttgaatttccctgcagctctttattgcatcatcaaaaatttttttaaagtcttggggatattaagattattactcttactgaaaaaattaacatagcaataaactgatatattaagcaaaaaaatccaacaccttcatcactatgttgagaactggttttgctgttaagtggttaggattaatttaagaagataaaacagatgccactgaaataaattaaatgtcctccaaagaagactggttaaataaatagcagtacaaggaaatactctataggtgtttgaaaagaatgaggcagatcaggccgggcgcagtggctcactcctgtaatcccagcaccttaggaagctgaggcaggcagatcacttgaggtcaggagtttgagaccagcctggccaacatggtgaaacctcatctctaccaaaaatataaaaaatttgccgggtgtggtggtgcacacctgtaatcccagctacttgggaggctgaggcaggagaattgcttgaacctgggaggcggaggttgcagtgagccgatattgtgccactgcactccagcctgggcgacagagagagactctgtctcaaaaaaaataaaagaatgatacagatcgatatgtgttgataaggagtgctctcctagctacattgttaagtaaatacaaatacaaataaaaaacagtgtgaacagtatcctgtcatttgtaaaatacattcatatatacacatatatatatacatgaatttgtatgtggatagaataatagaatttctccagaggaatacacacaaaaaatgaaatagtggatacttctgtagagagtaaatgggtgacaaaggtggggaagaaatatacttttcactgtctctttacatcatttttttcgtaccatttgcatttttgccaaaggcctgtattgcctattaaaaataattttagttgtatagtgctttacaattttaaaatattgtttaatatataattttattgaatatatatgcaatccaaagtagtaagtattatgcctttctcatagagatcttcaaactggttccaatctccaccctacttttcagctttccctctcttcactcgctgcatgctccagccacatcttagagaagattgatctccactttccctctctccttgccagcatggctccagctccactctcttactcgcttctaattaatgtaactaggcattgtgttctataattacagggcttgtcagtgaaatcaatagttacctcccatatgacaatgacattttagcttcatcaatctccttggagcccagtagcttctctgagccaacaaaacccccaagattattaacatatccctttgctctcactcatcttcatgcatgtgtataaatcagcagattctcaatccacaatttcatacaccctgccgatgattatttggtgataaaatgacaatcaaatttatattttaatggctttattgaggtgtaatttacataccacaaaatccactattgtacatgtacagttctatgatttttagtaaatataaagagttgtgcaacctcaaaggcatagtttttcatgataatcttaagaatctaacttaaaataacctagattataataggtttctgacatactcagtttctttcctctgacttcaactctcaagtgtgttccctgccttacttttcaatggaagacacctaattatattgtttccttaaaattacagcatgtgagacttggaagggcccttagaaatcaactacagataggaaacttagatccagataggacatatgatttgcccagagacatataacaggttaatggcagagtcagaactaaaacccaggaatttttttttttgtcgcccaggatggagtgcagtggtacaatctctgctcactgcaacctctgcctcctgggttcaagcgattctcctgcctcagcctccagagtagctgggattataggcgcgcaccaccacactcggctaatttttgtatttttagtagagatggggtttcaccatgttggccaggctcatctcaaactcctgaccccaagcgatctgcctgccccagcctcccaaaatgccaggatgacaggcgtgagccaccaagaccggccaaacccaggattcttattacaaacccaatcaactccctatgacaacaccgagcctcttctctcaagcattgctaatgtcctggaaatcagtgaatcaaccatcattaatcaatttgcctggctaaatctgaagatttgatgatgggaaaagggcttggcttgagggtgggtctagagaacaggtaggagatataaactcttttcctttacattccttctggatgaatttctttcttagtatttaggacaactaacggagaagataggttcctttctgtctaaagaaggatcttatgattatctgtcaatagtacctatcattattattactcttattattattgtattttctccagcgtatgttagcaagatgtgaaggtggtatgaaactgtagccaagaaaccacataggcaccgcttcctgcttttgcctaaaactgtgctaaaattagcccctaatccccacggatttgagccagggaaagcaatgtagcttctcatcttgtttttctagcaatcagtaagttgctagacagttgtaagttaaacaactgatgataaagagagaaataaattgtatatatttgtgtgatgagaactaaaaatgctctctgtcaccaactatagtgttacttggtgtcaccatagtaggagggaccaggccaacaattttgagatgctgaatatggcattctgaacttaacgagaaaactccaaaatactcagattgacatggaatcaccatcaactacttttaaattttttattagaaccttacctcccttttgagtacaacaccagaaaaaaaagaaagaaagaaagaaatcatatctcccccttaaaaaccatcttcccccacccccagtaattcctattctaagaatatatcctaagaaaaagcagagattcatgtacaaagaaattcatcactgttttttcctttttttttttttttttagagacaaagtcccactctgtcgcccaggctgtggtgcagtggagtgatcgctgtgatctcaaactcctgggctcagatcctcctgcctcagcctcctgagtagctggaactacaggcacacgtcaccatgcctagccagttaaaaaaaaattgggggtagcaacagggtcttgctatgttacccacactggtctcaaactccaagccttaagtaatcctcccacctcagcctcccaaagtgttgggattacaggcatgagccaccacacctggcccccatcacaatttttataagagtaaaacattggaaataatttaaaacaattgagggtgcttaaatgaaatacaataactccataaaagggaattgtatgcagccatgaaaaatcaccatctcaaaaaaatcttttcaaaaatttttatcatttgtaacagttttctgagataataatttgtataccataaaattcactaatttaaagtgtaaaattcactaatttaaagtgtaaaattcaaaggttttcagtacatttacagagttattaaactatcaccacaatctaatttcagaacatttttatcgccccaaaagagtgttcgtaccccttagcagtcactcctcacactctcaacctataaattgataagaaaaatgcaaatgatccaaaagaagattggacaaaggaaagtaagtcacagaaggagacatgcaaatgaatataaatattaaaatatatttatatttacaagtgataaaggaaatggaaataaacacagtgagataccatttttccatttactattttcatcagcaaaaatgagaaacactggtaacatccgctactggtaagcatcagggaaacagg[133 bp omitted]aaaccccatctctaccaacaatacaaaaattagccaggcatggtggcacacgcccataatcccagctacttggaaggctgaggcaggagaatctcttgaacctgggaggcagaggttgcagtgagctgagatcgcacaactgcactccagcctgggcaacagagtaagaccctgctacacacacaaaaaaagactatgaattgttaaaacctttttggaaaataatccagcaccatttaacttttttaaagcacataccattggggccaggaaccccacttcgggaatttatcctatagaaattaaaataccagaatgtaaagatagatgtacaaaaccataggaatagcgagttacagagccatgtgtgtagtatgatagcatctttatgccagtaactgttcttcacataaaaaatgcatgcctgctttcagtcctcccagaaaccctatgactgcagacaatattcttactctccagaggggaaactggggctcagagaaatgaagcaatgtactttaggtcttacacagttaccaaatggcagagctagcattccaatccaggtccatctggtcccccaaaccaagatatctgccaaggatgataactttctggttagagtacctgaaactccctcagtagaggtgggactaatctttcaggatgtcatttttaagagtgcaaagtgaattcacgtctcaatgaaagggatagaagtttgtaatgctggaatttggtgagagaatagttagtagtggaaaagggttgtggggaacatgaaaaactcaataattaaaattcatttattcatttatctaacaaatatttattagcatttactatgtaacaggtactgtttaaagcattgaaggatttatcaatgaataaaacagaaaaatcccttcccttggaaatttacatggggggagggggctgaagcagacaataaacaaattacatatgaaaataacatatgagatggcgaatagtgttataaagggatatcctttcaagttcacatagttgttaacggaatttgcttccttgcagctgtagaattcatgaaaatttgcttctttcaggctaacaagagagagtagatctgtgatctctagacttcgttttaaagagctcacctgattaggtcaggcttgccctgggtaattttccatttgattaactcaaagttaacttctaactaaggaccttaattacatctacaaaaatttctttacctttaccacataacaatctaatcaccagagtgacatccgtcatattcacaggtttcaccctcactcaaaggaaggggattattcatggtatgtacaccagggggcaggaatcacgggagcagatgtcaattgggcagttggatatatgagtctggagctcagggctgaggtctgaattggagatgtacgttatgatgtcatcaacacatagatggtatttaaagctatgagattgtatgagatttaaagcctccaaaaaaagtaatattgatagataagagatctgaggtatgagccctggagaacacgaatgtttagaggttgggaagatgaaaaggaaacaacagtggagacagacaagaaggagctagtgaggtaggaggcaaaccaggagagtatcttgtcctggaagccaggtgaagaaggtgtttcaaggaggagggagtgatcaactatgtcaagtgctcctgcttggtcatgtaagatgatgacaggatagtccattgaatttagtaacatgacagtggtcctgacaaaagcagcttacgtggagtggttggggtgatagcctcatttgaatttgttcaagagagaaagaggagagagaaattggagttggcaagtgtagacaattctttcaaagaacttggctgtagacaggagtggagaaatgggtgcattagctagaacagaaagtggggtcaaggccgggtgtggtggctcacacctgtaatcccagtattttgggaggccgaggtgggcagatcacctgaggtcgggagttgaagaccagcctgaccaacatggagaaaccccgtctctactaaaaatacaaaattagttgggcatggtggtgcacgcctgtaatcccagctacttgggaggctgaggcaggagaatcgcttgaacccgggaggtggaggttgtggtgagccgagatcgtgccactgcactccagcctgggcaacaagagcaaaactccatctcaaaaaaaaaaaaaagtggggtcaagagaattttttattatggaagaaaaacatgcctatatgccgatgggaattgcccaataagaaggaaagttcgattatgtgtatggaggagagggcttgctggaacaatgaccttgaagtagtaagaaagaatgagatccagagtacaggtggaagggttgtacagataggtcatctacagaaatgtgatggaaggcagaatataggcaaaaatgcaggcagatgggtagatgtgttttgagggtctgtggcaattgtcctctgatactctgatttttagggcaaaccgaaagtgtctcctgcattctcccacactgcctggagtgtcagcatgagattactttcaggtgttcccgcaaaacaggcacattttatgtaccacttgtaccacttaagaggggattttagtagctttgtgtttaacatttattagaagaaggtaactagtacacctaatgcatgatttttcagatataattgcaattttaaaatgtaaacaaaagaaaagtgttagctaaagtacagaagaggttgaagggatatagcaaaacttttagtcagttgtgaataactgacccttgagagaatgtcttaaggtactggatctgctggagtccctctttaagagcagacatctctgagataacacatttagtcagcttcattcctgaaattctactgtgaatgaaactgagacatatcaggactgaaaggaatcccccagggtctgctagtttacattcaaggataaagaactctataccactgaagactgagacagtttctttcatcctgaggggcctctgactaaaagcaaaacaaaaatacaacaaattgaaaaggcaaaatttcttatataaccacacagtgaatataaacagaaagcctagagccatgcattatgggagatgccacagggaaaggagtctgtagatgattgagaaaaagggtttctccaggtagagagataggaaattgtggtagacagaataatgaatcctcgaagatgtctatgtcttaaacccctggaagctgtgaatatgttaccttacatggcaaaaaggactttgcagatgggattagttaaggatcctgagatgggaagattatcccggattatccagatgggcccagtgtaatcacaggggtccctgtaagagggaggcaggaggatcaaagtcagggaagatgtgatgacagaagcaaaggttgcagtgatgtgctctgtagatggagaatacagtcacaagcaagaaattcagacggcctctggaaatggcaagaaaacaaattctcccttagggcttctagaaggaacacagtcctgctgtgatatggtttggctctgtgtctctactcaaatctcatgttgaattgtaatccccagtgttgggggagggacctggtgggaggtgattggatcatgggggtggattccccccctgctgttctcatggtagtgagttctcacgagatctggttgtttaaaactgtgtagcacctcccccttcactctctctcctgtcaccatgtgaaggtgtgcttgcttccccttcatattttgccatgattataagtttcctgaggcctacccagccatggctcctgtatagcctgcagaactgtgagtcaattaaatctcttttctttataaagtctcaggtagtttttttatagcaatgtgagaatggactaatacatactgacagcttgattgtaaaacttttggcctctagaactgtcagatagtaagtctgcattattttaagccactaaatttgtgttagtttattagagtggcaataggaaattaatacagacatgatggaaacttagaatgccaggtttgaaaaggctttctggcaaagcctcctgtctggcctgttgattcctggaagatgggagtgaaacagatccgaattcatagcatattttctttattgttcttgtggctcttggcatatgtttctctgtattaatattagttatcttcccattagatgtacgctacttgtgggcagattcagttagcatatagcacaggaccttgcccatctaacaggcaagcagcaatgatgctttgcaattgcataattttagctggagtttctaaaaggctttcacatatgaccctacaggcatcaacataaactgaaaatagaagggcaggaattatagaaggtgtcacagattggagagaggaagttcccagaagagactgtaaaagagacacttggagtgagaaagagaggaaaggggacaaatgccaaggaaaggaaatgagttttccttacccaggaaaaattggcgaaggctcacaacctttgactcttatcttgaaagcaagccaggaggcctatgcaggagtgagagaagccacaaatcactacatggcccgtggaagtagagcaggttggatcccagctgagggtcccatccagcatcctgacccccactcctatcctagccagtctgactggcaggaatgcaaaagggatgtttcctgcctgcctcaagagtttggtaactcttccattaggtagctggttagatctggaggagaaagctacataacccacttggggtttcagagggagccaaagtcaacttcttcagcacaatgccaggcaagctagacagatggcagcagaggagctatcagctcctgaatttcaaagaccagccaaggggagagacagagcttggccaccatggaaatagagaagcccaagaagataggggacccataattttcaggcctagtaattctcaatgtccatgtatagtccactcatgtgacttaatgtcttatgggcagtatttttcagtcaattatgccttgtaaaacaactctgggaagaggaactattctgtgaaattgctgggtcatatagtagttgcatgtttagttttttaagaaaccatagtcaggtgcagtggctcatgcctgtaatcccagcacttcgggagaccgaggcaggtggatcacttgaggacaggagttcgaaaccagcctgggcaatatggcaaaaccccatctctacaaaaaatacaaaacattagccagcatggtggcccatgcctgtggtcccagctacttgggaggctgaggtgggagaatcgattgagcccaggagtttgaggccgcagtgagccatgatcacaccacttcactccagcctgggtgacagagggagaccccaaaagaaagaaagaaggaaagaaagaaagaaagaaagaaagaaagaaagaaagaaagaaagaaagaaagaggaaagaaagaaactgccatactcccttccagtatgattgtatcattttacattccaaacaacaatgtacataagtgattccatctctccacacccttactagcatttgatgttgtctctaatattatttattctgacaaatacatagtgatacttcaatgtggttttaatttgcatttcccttacaatgaacatcattaactatgcttatttgctatctatatctcctcattcatggaatgactcttcatgacttttgttcattttctgattgaattgattggttttattttttaactgttaagtttttgggagttctttaaatattctgtatacaggtcctttgttggatatgtggtttgcaaatattttctccaagcttatagcttgccttttcatcctctttcgcaaagcagaagtttttcattttgattaagtccaatttataaatttttccttttatggctaatgcctttggtgtcaggtatgagaactattcacatagccctagatcccaaagattttctcctgtgtttttttttctaaaacctttatagttttgtgttttacacttaagttcataatccattttgagttgatttttgtgtaagatgtgatatataggtcaaggtgtttgtttgtttgtttgtttgttttttgcctgtggatatccaattgttttagcatcatttgttgaaaaagctatatttcctccattgacattcttttgtgcatttgtcaaaaatcagtttgccatatttgtttttaagagtctgtcctggattctctcttctgtccctccaatctgtgtttatccctccaccaataccacactatcttgactaccgtagcatcatattaagtcataacacaagtgattccatatactttaatcttattaacttattttcactacgttttaactattctagggcctgttgctttacatataaattttaaaataaacatgtctttgtctacaaaagttcttgctatgattctaataattattgcattaaacttgtatatcaatttggggagaattgatgtctttactgtgttcagttttccatccatggtatgtctctccatttatatagatctttgatttccttcatcagaattttgtagtcttcagcatacaagtgctttacatgttttgttagatttgcactgaagtattaaattttttagctattgtaaaagtattctatttttcatttcagtgtccacacattcattgttgatctagtatctgacagccttgctgaatgcatttattagttctaggtttttaaatgattcctgagatttactgtgtagacagttatgtcatttgcaaatagaggcagttttatttatgcctttctattttgtatgccttttatttccttttctcatcttattgcactgactaaaacttccagcactttgttgaataagagtggcagctgggcgtggtggctcatgcctgtaatcccaacactttgggaggccaaggcatgaggatcacttgaggccagaagttggagaccatcctgggcaacatagtgagaccttgtcttaaaaataaaataaaataaaagagtggcaagagagggcattcttgtcgtcagctataggtttttgtacttgccttttatcaagttgaggaatttccctctattcctagaaaactgagtatttttttattctgaatgggtgttgtattttctcaagtcacttttctgcatcaatttatgtgatcatgtaagttttcttcagtggccttttagtatcacagattacattgattgatttttgaatattgaactagctttgcatctctgaaataagcactattttgtcattatgcataataccttttatacattctgaattctatttgctaatatctttttttaaaaaatttatttttaattttgtggttatataataggtttatatatttatggggtacatgagatattgtgatacaggcatgccatgtgtaataatcacaccagggtaaaaggagcatccatcccctcaagcatttatcctttctttgtcttacaaacaacccaattattctcttttagttattttaaaatatacaattattgttgactgtagtcaccctattgtgctctcaaatactagatctcattcattctatctaattatctttttgtacccattaaccatcccctcttcccctccaacattacccttcccagcctctggtgatcatccttctactctctatctccatgagttcaattggtttaatttttagctcccacacataagtgagaacatgtgaggtttgtctctgtgtacctggcttattgcacttaacataatgtcctccagttccatccatgttgttgcaaatgacaggatctcatcctttcttatgactgaatattactccattgtgtataagcaccacattttctgtatccattcatctactgatggatacctaggttgtttccaaatcttggcttattgtgaatagtgctgcaataaacatgagagtgcagatatctctttgatatactgatttcctttcttctgggtatatacctagtagtgggactgttgaatcacatagaagttctatttttagttttttgaggaacctccatagtgattgtgctaattcacattcccaccaacagtgtacaatggttcccttttctccacatcattgccaatatttgttattgcctgtcttttgaataaaagccattttaactggaatggtatatcatctcaccccagttttgatttgcatttctctgatgatcagtgatgttcagcactgtttcatgtacctgcttgccatttgtatgtcttcttttgatgtttattcagatcttttgcccgttttaaaatcagattattagatttttttttcctatagagttgtttgagccccttgtatattctggttattaatcccttttagataaatagtttgcaaatatattctcattctgtgggttatttcttcactttgttgtttcctttgccaggcagaagcttttaacttggtgtgatcccatttgtccatttttgctttggttgcctgtgcttgcggggtattactcaagaaatctttgcctagtccaatgtcctggagagtttccccgatgttttcttgtagtagtttcatagtttgaggtcttatatttaagcctttaatcccttttgttttttcatatggtgagagataggactctagtttcattcttctgcatatggatatccagtgttctcagcacaatttattgaagagactgccctttccctagcgtacgttcttggcaactttgtaaaaaatgagttcagtgtagatgtgtggatttgtttctgggttaaacaaattttcaagagaaaaacaacctcattgaaaagtgggcaaaggacatgaacagatgctttacagaagaagacatacatgcggccaacaagaatatgaaaaaaatctcaatatcactgatcattagagaaatgcaaatcaaaatcacaatgagataccatctcatgccagtcaaaatggctattactaaaaagtcaaaaaataacaggtgctggcaaggttgtggagaaaagggaacactcatacatttgttggtgggagtgtaaactagttcaaccattgtgaaaagtatcctggagatttctcaaagaactaaaacagaactaccatttgatccagcaatcacattactggtatatacccagaggaatacaaatcattctaccataaagacacatgcacacaaatgttcattgcagcactattcacaatagcaaagacatggaatcaacctaaaggcccatcattggcagactggattaagaaaatgtggtacatatacaccgtggaatactatgcagccataaaaaaagaacagtatcatgtcttttgtgggaacatggatggagctggaagctattattcttagcgaactaacgtaggaacagaaaaccaaatactacatgttcccacttattagtgggagctaaatgatgagaactcatgaaaacaaagaagggaacaacagacactgggtgctccttgagagtggaggttgggaggatggagaggaacagaagagataactattgggtactggatttaatacctgtgtgattaaataatctctacaacaaacccccatgacacaagtttacctatgtaaaaaaccttcacatgtacccctaaacctaaaataaaagttaaaaacagaatatatcattattaactatagtcatcacatcgtgcaatagatctcttgaatttattcctcttatctaactgaaattttgtatcctttgaccaacatcttcctcaaccccttcactgcccccagtccctggtaaccaccattttattctctacttctatgtgttcaaatgtttaagattccacatataagtgagatcacatggtctttgtctttctgtgcctggcttatttcacttaacatgttttccagttttacccatgttgtcacaaatgacacgatttccttcctttttaaggcggaatagtatttcgttgtgtacgtataccacattttctttatccattcatctgttgttgaactcttagattatttccatatcttggctattgtaaataatgctgcaatgaacataggagtgcagatatctcttcaatacactaattgtattttctttgggtatatacccagtagtgggatggctagatcatatggtaaaaattttacttttaattcttcgaaaaatctccatactgttttcaataatagctgtactaatttacattcccattaacaatgtacacgggttccctttctccacatcctcacaaacacttgttttttgttttttgttttgtctttttgataatagccattctaacaggtgtgaggtaatagcacattgtggttttaatttgcatttctctgacaattagtgatgcttagcatttttcatatacctgttcatcatttgcatgttttcttttgagaaacatctattgaggtcctttgcccaggttttttgtattcctgtatttttgtattctttaatcaggttatttgtattcttgctgctgagttattttagtttctcatatattttggctattaaccccttataggacatacgctttgcaaatgttttctctcattacatacattatcttttcactctgtttattgtttcctttgctgtacaggagcttttcggtttgatgtaatcccatttgcctatcttcacttttattgcctatgtttttcaggtcatatgcaaaaataattgcctagaccaatgtcatggttatttcccctgttttcttctagtagtttcatagtatcagttcttacatttaacactttactccattctgagttgattttgtatatagcgtgagacaaggatctaatttcattcttttgtacataaataattgttcaaacaccaattattaaagagactctcctttcctgctttccccattatgcttttccccatttcccccattgtatgttcttagcacctttgtcaaaatcaattgaccataaatgggtggatttatttcagggctccgtattctgttctattggtctatgtgtctgtttctatgccagtatcacgctgttttgattactatcgctatatagtagattttgaagtgaggtagtgtgatgcctccaggtttgttctttttcaagattgttttggcagtttggggtcttgtggtttcatacaaattttaggattgctttttctattttagtgaaaaatgtctgaaattttgatagacatttcactgaatcaatagattgctttgggtagtatagatattttaacaatattaattttccaacctgtgaacatggaatatctttccatttatttgtgtctttttccatttcttttattaaaattttatagtttttggtatacaggtttttcacgtccttagttagatttattcctaagtattttttgtagctattgtaaatggaattattttcttgatttctttattggatagtttgctgttagtatatagaaatactaccgaatttttgtatgttgattttgcatcctacaactttgctgaacttatttgttctaacaggattttttggcagaatctttagggttttctacacataagatcatgtcatctacaaacagggacaatttcatttaacttcttcctttctaatttggatgtctttctttctcttgcctaattgctctaactagggtgtccagtgctatgctgaatagaagtgataaaagtagtcattcttgtcttgtttctaatcttagtggaagagcttttaacttgccactattgagtatgatgttacctgtgggtttgtcattcatggcttttattatgttgaagtacatttcttctatatctaattttccagagtttttttaatcatgaaaggatgttttcaagcaattttgttaaatgcttttctgaatctattgagatatcatatggtttttgcgcttcattctgttaatgtagtgtaccacatttataggtttgtgtatgttgaactatccttgcatccctggaataaatcccactgatcatggtaatgatcgatttctcatcgagccttagctaccttcccgcggggcagggctcgggacctgcagcccgccatgcctgagcctcccacccactccatgggctcctgtgcggcccgagcctccccaacgagcaccgccccctgctgcagggcgcccagtcccattgaccacccaagggctgaggagtgcgagcacacggcgtgggactggcaggccgctccacctgcagccctggtgcgggatccactaggtgaagccagctgggctcctgagtctggtggggatgtggagagtctttatatctagctcagggattgtaaatacaccaatcagcaccctgtgtttagctcaaggtttgtgagtgcaccaatcaacactctgtatgtagctgctctggtggggccttggagaacctttatgtctagctcagggattgtaaatacaccaatgggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactctgtatctaactaatctgatggggacgtggagaacctttgtatctagctcagggattgtaaacgcaccaatcagcgccctgacaaaacaggccactgggctctaccaatcagcaggatgtgggtggggccagataagagaataaaagcaggctgccctagccagcattggcaacccgctccggtcctcttccacactgtggaagctttgttcttttgctctttgcaataaatcttgctactgctcactttttgggtccacgttgcttttatgagctataacagtcacctcgaagatctgcagcagcttcactcctgagcccagcgagatcacgagcccaccgggagtaaggaacgactccagatgctctgccttaagagctgtaacactcactgtgaaggtctgcagcttcactcctgagcccagcgatatcacgagcccaccgggaggaatgaacaactccagacgctctgccttaagagctgtaacactcactgcaaaggtctgcagcttcactcctgagccagtgagaccacgaacccaccaaaaggaagaaactccgaacacatctgaacatcagaagggacagactccagacgcgccaccttaagagctgtaacactcacggccagggtccgcggcttcattcttgaagtcagtgagaccaagaacccaccaattccggacacagtagtgaaagtccaggttacacccttggcctcctttcatacctgaagggggctgttgagtgggggtaggagttccagctccccactcagggtccactgatacctggccgagaggtacaggaaggcttcttaatggtctccatgtgggttctactgacataagtggaggaggctcttttactcccaggaagtggctaaagtcctgactctcttccaagcctcctctgacagcaccaggcaggagggttaggaggccttcttatataaccttgtgtgggtggaagtctaggcttcccactaggcctttgctggcatggataagggtgttgctgcaatggtctattgggctagagaaaacattttccttggggcctttttttatctctactcattggcagttctgaattgccagcctctgcagttctgggtcgctgccttctttagcccaagtctaggatatatgaggcaaaaaaaataaaaataaccacccaagaaactcaccaccatatcatttcttgggtcccaagatccttaggcggtctgccttctcttcacctttcagagccttcttatgtttgttttatatacaatgacgagtttttagttatacttagtgaaaaaatagcaaaagttatgtgtactccactttcccaaaagcagaagtccgagactttaaaaaataattaattcaaaggatagagatcaaaggtaaaaatattttcacactcttagtctcattcaaatcaagaaaatgggtagcctcaaggtgtggggctctgtctctaaggaaatattacccttggctttactatcctttaagcaatagggaaactatgcacttttaaaagagccccttgtgttttgagctgcttgtgttcattcttattcatcaagtatttttttttttcaaagtgagctccgcagagtaccttcctcagcattatcttgaaataatttaagacatagaataccatgtcctgatctagacctgctgaattagagcccaggattggagattaggaacctatattttaacaatcatctcctgcccccaaggtatgagaacctctgatttaagccattgataaaatttctgaaggagatcaggccaataataaagacttgtaacaggcctggagactgtccttgagaagctattaatcatttatcaggacccttggggcagacttggtcaaccagctactaaacccccttattattctcacagcgagtccttattgtgctgctttgcaaatatcatgaaaatcctcaggtagtgctttgccaaatttcacttgttttatctgctgcattgccctga[137 bp omitted]agtgaaactctgtctctactaaaaatacaaaaaattagccaggtgtggtggcaggtgcctgtagtcccagctactcaggaggctgaggcaggagaatggcttgaacccaggaggcggaggttgcagtgagccgagatcgagccattgcactccaacctgggtgacagagcgagactccatctcaaaaaaaaaaaaaattaaaaaataataaaaaataataatgaaactagtctgacaggtttcattcccagtgaaattacactgggtccagtgaacataaaccatccttttaaaataatccactttagattgtctcctggaatcaacaacaagcttgttctgtccatttacacttcctctattatttcctttttgaaatccatgatcacatttgcctgtctttaggcttctacgacccccctgcatatgctccaaattgatgaaaataaaattatccccaagggtggtttagaggtctcatttgctagttcttccaatattctgagagatataatttgtccagacaactgaacttggttaaagcaatgaaatactctttgacaaccattttacataccctggacttttcttcttttatcaatatttggtctaaactcttgttattcaaagtatggttcgaggaccaacagtagcattacctgggagcctgttagaagtgcaaattattgggccccacccagacctaccaaaccacaatctcattttaacaaaattcctaagtgatgtataagtgtgttaaagtttgaaaagcattgggctagactgttcagtatgtaaatttctccttgacaaaaaatataggtgcaaagtgagaacagaggagttctgctctatctttatcatccatcagtatgtcaatatcaattggacccctttctcaattgtcttctggctcttaacacaactttgtaataattatttatgtaactttgtaaaaattctttatgttgctcttatcatttcttgaaagcctcaggtctacatctggtgtttagccttctggacactgtttatgtaggtctacaccagtctcctgcatttattattggttttgtgggggtcctttccaaatttaacctgctaagaactaaaagtttctttttctcttttctttttttttttttttttttgagacagagttgcccaggctggagtgcaacagtgtgatcttggcccactgcaacttccacctcccgggttcaagcgattctcctgcctcagcctcctgagtagctgggattacgggcatgagccaccacgcccgactaattttgtatttttagtaga[143 bp omitted]tttctcctatgctgttccagtttcaacttctccatgtcttctacctgcaaggttacctgtagaaatctaactgcttcgtgtccgtcatgaaatgccaatgtacatgctaacagtgctttctatcacttctcccaaagctttcaatctttgagatccccaaatggttttggattagaagggtgtcctccccagctctgtgccatactctgtcactgaggctttgaaacaactcagcttttgctcagtctcttaaaatctcccttaggcagggccagcaatttattatgttcattcatttaatcatggaagttaaaggtccggaaagggaattgatgccatattatccccttggagctcttcttatcctcttctagcccttctcatcaccaaaagctcttgtcttatctcatggttacaaagcaaatgaccccacatatataagtgaatgcaaatagacactgatgtgtgtttaggaaacaggaggaaagaagagactgtatactttagtagtgactggattccagttcagtccatcaaatgtgcacagttatcactgcatttgattaatttttaaacatttagggaatttcccagatatctttcttttttgttgtggttttttttgtttcacttttgtttttcccagatatctttctaagtattaatttctactttaattcctttatggttagtaagcatatcttttattatttttatcattttatattttttgatacttcctttacagcccagcatatggtttctcatggtgagtgtttttcatgcacttgaaaagaatgtcttctgttgttttgggagagtggggaggagtgaactataaatgtcaattaggacaagttgattgatggtgtcttaatgactgttaacttgttcaactgattactgagcaaggagtgttaaagtctccaaatataattgtgaatttgtctatttctcctttaaattataccagactttgcttcaaaagttttgcagctctgttaccaggtacacacacttagaattttgtcttcttacgaatgaaccattttatcagtatgaaatatccctctgtatctctggtagtcctcatgtcttaaagtctactttatctcatgataatattgtcagtagatttcttatgattagtatgtgcatagtatatttttccttctttttactttaacctgtctttatatttacagtaggtttcttatcggcagcctgaacaacttatgccttcatttggggtgtttcctatgtttaatgtaatcattgatatggctgtttctaagtcttccatcttggtattttttttccatttgtcccatattttccttgttctttttttcctcctcttctcccttccttgacattacttgaatatttttagtagtctattttggctttttagccatatttcttatttgatttttttatttttagtagtagtattttatgaattaaagggttaattcatacgaagacagaattcttaaagtgtatgtacctgataacaaagctgcaaaacatttgaagcaaaaactggtagcatttaaaggaggaatagacaaatccacaattatatttggagacagtaacgctcctttctcagtaatcaatacaagttgatagtcattaagacaccatcaatcaacttgtcctaatctggggattacaatatgcatccataacttactacagcgtacttttttttttttgagatagggtctctgtctgtcacgcaggctggagtgtagcagcgctatctcagctcactgcaacctctgcctcctaggctcaagcaattctcccatctcagcctcccaagtagctgggacttcaggtttgaaccaccatgccagactaatttttgcattattggtaaatgcgaggttttgccatgttccccaggctggtctctaactcctggctcaagcactccacgcatctcggcctcccaaagttctgagattacaggcatgagccactgcacttggccaataacttattacagtgtactttgaattaatattgtaccaattcacacatataatgtaaaaaccttataacagtatatttccttttactcctcccttttccagtgtactatagtttttatgcatatttacttctatatagtttatagatcccataatacattgttagtctttttgctttacatagtccattgtcttttctagtacattaagaaattcaaaaaacaagtttttaaatatttactcaagtgtttaccattttcatttctacatgtagctttgaatttccagctggcataatttccctcaagcctgcagaatttcctttaacgtttctcatagagcaagtcagcttgggatgaattataattgattctcattatttggggatctataaagtcatcacacacactgagttaagaaatactgaaccactgatcctaggggaaatacagtaggttcatacaagcctctggtcacaacagtttcatcaactgatcaatatgtagccgtgtgttatatgtgtttctgtttgaagatatcttctatattagatactgttgattcattgacatttaactcatggccaatggtattttaatttatgcttgaacaaaacttaaataacacatttttttttccattaggcatatcacagccttgttgcacttaggaatgctaaacatcacttcagtactacattttgggaccgtttaagatagtgaaattactaataaaaatgtggaaaatgtgacactaaatagaccatggaaatgacacttttttacagtatgagaactgaagcaagaaggcagaacattgcattgtttggcctcagctgggaacatgcactttaggcaattcaaattttttgctgctctccatgtgtccctgaaagctggtgaaagtaccatgagaattgatttggggttacaaataaattgtagcaagtaggtgaatttgcaaataaataatttgaataataacaattgactatatcttatctttctggaatgttttgtcttcctttaaagagtgttgagctttggggggacattgaatttttttctggcaggctattacttatctaatgtctaaaaatatttgttctatatattttatttatatttatttacagcaagaaggtaaatctgatgctcatttctccatcatggttaaatcatccctgcatttggagggtgtgatggttaatactgagcgtcaacttgattggattgaagcatgcaaaatattgttcctgagtgtgtctgtgagggtgttgccaaaggagatgaatatttgagtcagtgaacagggagaggcagacccactcttaatctgggtgggcgccttctaatcagctgccagcatggctagaataaagcaggcaggagaaggtagaagagtagacttgctgagtcttccggccttcatctttctcccgtgttggatgcttcctgccctcgaacatcagactcagcttttgggctcttggacttcagcttttgggctcttggacttataccagtgatttgccaggggctcttgggcctttggccacagactgaaggcttcactacttttaagattttgagactccgactggcttccttgctcttcagcttgcagacggcctatcgtgggacttcacctcgtgatcgtgcgagtcaattctcctaataaactccccttcatatatacatctatcctattagtcctgtccctctagagaaccctgcctgactaatacagaaggaaaggcataaatgaagtagtcactcatctcccaatagctgttgtgcgtatgtagatgaaaaggagtacagagttacctatgcaaaatgtggtcattgtataaagaacgacttttcaacactgtgctaggggttatgagaaataaaagagaaggcaaaacccagctcttattcctaaggactttaagtttcagttggaaggcaagttgtcatatgtgaaatgtcaatgtttatcttacttcaacccctaccccactggtcctaaccctgttcctctgtgagtcttccccagaaaatacttacggagatgtcttcaggctgaggagccaaggaaaatttctttgggtattgtacaccataccctcaaattgttctattgtacttaggtcctacgtttaccatttagagctaccaactcattctgctttgagtggaacgttccagaaaaagccttgtttcaggaaccccatcagtcctgggaaaccagaatggttggctatctgagcccatattgctcacagcattgccagtgccagcctgggtgaccaagtgagaccctgtctcaaaaacaaaaacaaaaacaaaaaaagttcctgagagtttcatacattttttggtgatatcagcatgcaaataagatccacatatcacaattggttgatacgtcttttaagtctcttttcatctataggttcctccactatttctttttttttcccattagaattgattagtaaagatactagttaatttttcctatagagtttcccactgtctatggattttgctgattgcatcctagtaatatatttcaagtaaactggtagttagatctaggggcttgttcagattcaggtttgattttttagcaagacagcttcataagtggtgctgtgtactttcatcagaggtacataatatctggttgtctctcttcttatgatgctggcagccattgatgaccattgcctagtccactatttcattaggaattgtcaaattgttaccagggggtccttgctcccagagctcccaagatggtggcaagcctcgcgttctctgacctggggttcttgacctcatggattccaaggaatggaatcttgggccatgcagtgagtgttatagctctattagaagccgtgggtcatggaagagaaccatggaacccagtgactagtgttcagctccatcaggatgaaacccgggcacttagccgtgcaggaacaatggcaagcctttagcctgatcgggagcggcaatgggcaccttgctggatcaggagcacagtggacaccctgctggatccggagggatggaagtcagtggcgggtctgcaacggcggcaaacaccagtggtggatggcgagcgaaagctcagctgtagccataagaaacatggaccaaaagagagtgcagttgcaagatttaatagagtgaagacagagctcccatacaaaggcagggggcccaaaaagggtagccgttgcaggctcaaatgcctgggtttatatcctgatccttgtccctcccgctgtgctctcaggcaacagatgattggctatttctttacctcctgtttttgcctaattagcattttagcgagctctctttactatctgattggtcgggtgtgagccaagttgcaagccccgtgtttaaaggtggatgcagtcacattcccagctaggcttagggattcttagtcggcctaggaaatccagctagtcctgtctctcaaaatggcaatattctatcattctttcttcacccattaactggaatactcctatgaaaagaaactccccatcaacaaattttttactaccccgtggtacaattgtatagaaaagacttcagtgacaactttgctgatagatctccatatgcacctgtgaaaggaaaataaatcttgggaccccaaaatcactaagctaaaggaaaaagtcaagctgggaactgcttagggcaaatctgcctgccattctattcaaagtcacccctctgctcactgagagagatgcatatctgattgtctcctttggagaggctaatgagaaactcacaagaatgcaaccgtttgtctcttatttacctatgacctggaagctccctccccacttcaagttgtcccgcctttctggaccaaaccacaaactaatgttcatcttacatatgttgattgatgtctcatgtctccctaaatgtataaaatcaaactgtgctctgactaccttgtgcacatgtcatcaggtcctcctgaggctgtgtcacgggcacatgaccccaaccttgccaaagtaaactttctaaattatctgagacctatctcagatattcagtgttcaaatttcggtaaccacaaagggattctgagtggaggtacccctgaactttgacaaatctcatattggtgcttggtaccagcatgagcaactttgtggctcaaaccaataggacaatttgctgaggtctgggagcaccccctccagagaatccctgatatccctaaatttggtagagatctaaagtttattttgctgtacaactcccttttttttggagttttacttgcttctaacacggaaggcaagattccctgcttccatgacgatggaaagcaagtacctcctttatggagtttgagctcactcccaacaagaaagacgagtttgagtttttttcctgcttcaaggatagtagaaagcagtcttcaacctgagacccattcctaggtaagttaacaaccagctggttttaatttctccttaccattagagtgctcagtgatcatattgtcggggttttttgttgttgtttgtcctggtctttctcccatcagatttgaccaactccacctgacttggtcaaatccgagtgagaattccaaattatggataacaaagcctctctagtttggcaaaaattcctcgcagctgcaaaagaggaaaaaacaaaaaaagccatgcgcttggattttgtgtttgcttcctgtcttaaaaaacaaatgttctttcgtttacttttcttccactctatacctccttccccctatgccatctgcagtaccaaaaaatctagagaaggcttccaatgacttgagcccctttcaagaaatcagaacaaagataccactcaccccttttggagtgttctgttttccttgtggagttccaagagtcatggacagatttttcttaggtctaaagctctgttttcctgtattgcatgacctgacctttttggctttgggagtaccagaaataaccttgtactatgagagaacttgacctcggcatgtgtaatggcagacgagagctacaaaattaggggtggctgagcacagtttacaggaagtggtcttcactgttgttgttgttgtttccctcctaggaaactgttatttaaggatcttaattctagttcagagatgtattctaaagggccttctctattgctttttctcccaaaattaatctcgattcagcttgtctgtgcgcatttgcgtgaggaactgaactgttgttttcatagataaatgagggactgagttttctcagctctgaagagaaagggcattttgatcctcccagccaaaaggcactccagggtgtatttcctggataagccttttttttaaattaatttttgttggggatttccctgtagggccactgaacgtttcgaggggtcaatcccccagacattcccacatggcccccagtcaaatcagctgttatttttctattaagataaaaaccactgtttggatccaacacggtttttttttgcaagctggtgaatttgtatttacctcatggctaaggttctgaagtaaaagcgataggatctttgtgtgtgtgtgtgtgtgtgtgtgtgtgtgtgtgtgtgtgtgtgtgtgtgtgtgtgtgtattttaaaggcctttataatttttataattttatgtttaattggcaattaaatccgttttaatttccctctagcacaccaaagtatttatctccataccttatgatgtatatcttgctatttgattttcacctgacttgtttcctttaatatgcaaatttaagcctatttagctgacaactgcctagggtagtgaaacaggttatgaagaatttgaaagcccaagatagggaaaaataaaaggtttttatgactctataagatgtacattctatcagcatgcctaatacgtctatgtatttatgtacccaatgtttcactactgaaaatatatgcaagagctctaattaattggcttaagaaaataaaagcacttgaatcaaatactttatcaggaaaaaacaaaagactagtcaaatgctttttcaagtttacataacttaagtaaaatcttcaataaataagctagctttaaaattattggtaaagtaatattaaaaatgtcttaagaattgccagcatacatttttgtttgcatttattaatcaagcaatttcatacttatccctgccaaatactacaaggtgtcaaaatttggcataggggttacaaaaccataaacctagcccaaaacagaatgatctttgtcatgtaatctttaataaataagacattgatattagtttaatgaaaatagcaacatcttgaatttagtaagattgccataacttctaatcttctggctttatgcagtccagcccacaggcagtaaggtttgttttcagaagggactgttaccatctttgtctcaaagtcaaactgtaaattgaattcctcccaaacttagtttggcctgtgctcaggaatgaacaaggacagcttggaggttaggagcaagatggagtcagttaggtcagatcttttcaactgtctcagttataattttgcaatggcggttccataactttaaatgatgactgccgcagttttcataaataatctaggtaaacaattgaaataattaggtagacgtaatgggatgaatacttgtagacaacaaactcatcataatttagactctaaagttatattaaattaaataatagatatttaaaatattaaaagtacaaaaattagccaggtgtggtctcgtgcacctgtaatcccagctacttgggaggccgaggtgggagaattgctcgaacctgggaggcagaggttgcagtaagccaagattgcatcactgcactccagcccggacgacaaagcaagaccctatctcaaaaaaaaaaaaagaaaagaggatttattaaaaaaaaaactttcatatgatcaagttgtctattaattaaagggaaattataatggtctttctagagattgggcttgatgtaagaaaaaaccacttacacactaaataattggttagaataatgaaattttcttaagggattgatttactcttaataaattatgagagattttaattttttaacccaaagttcaatttgtattgcatcttgccatttttggttttctctccccttttaaagggcaagaaatagtaatgctctccaactcatttttcaactcatataagtttttctccttgagttttgtttgttgtggcctgatgctaacaatgttttcttaaaagtctaaaggaaattctttcttccaacataatattctgtgcagtgccgaaggtcttttcttttgccttttggtaactggcctaacagattttatggtttattgaaacaattcctatgctattattattaagttttggtttacttagggaaaaaaatgaaataaaaaaaattttttcattaaggttattatattcatgtatctttctgtatgggcttgtaaagtcattgtgacatagagttacagggctttggctcctggatctaaaaaggacaccaagtcctccgaaatcttaaacgctgacagcaattaaagcctcatcttcaggcccagtagagatgccaatcaaaataaactgcattcctgagacacaggccagaaattaaagctatctaactcctcaaggccagggactattgcagaagaggtgggcatgagattgtaagggccaatgttgagagataaaataagttcagtttctctatgaattaatcattaatgtcgaaggcacactgatggaagaccagcatatgggcccctgtgtcagattaataagtttttcttgaagcattaaccaactccttaataaaggttataaagattataaaaggcttattgaagttatatcttatgctcaagattaaaattttatagattgtttataaaattttgaaaaacaaatttaattggcgtcatgctgtttttattagggcttattgtttggaaaataaagtctcctctctcaaagaatgaaggattttgtctttttttgaaatccttgagttaccagtttggtgaaatgaatggcttattttacaatgatctgtgatatcaagtgttttaaacctttgatatttgacaccttccaaaatcaaattataaattatgtctttttctgatctaattaatcctttaagatattaggttccccaaagtccaaaaatgacataatttggcctatttcatataaacatcatacaggaaacattgtcaagtgtgaaatggtgtttggttttctttgagctgtatctatataaatatgttattggtatgtgttccaaaattatgggaaagtcctataattctgatatgacttactgtacataatcagtaataattataattgttttcttaaattattgtgtgccacagaggcaacaaatttccttgtccattgtgtctttgactatggctgccctaaaacttttttcatccatggacaatttttgtcttgttttcgtcctctttagaaggtagttttataatcagctataaaattctaacaggtgctcttgaatacaagtttctgaaaatttttgagattgtgacatcagaataaaagaaaaattttcaggactcatggagaactgaaatgttcatgaatatcaagcagaacaggaattaactacatggactgacatgcataagtacaataagaatctgttttcatttataacaggacacaatttgagaaactggttattttaccaaagctttgactggaatggtgtgctttcctttaaggaatcaaacttgacttatggagccaataaaagtcccatgggaaaactggccttataccttgtctacacagtccctgtacagggttcctgacatgtggtaagtaaagaatgccactttctgacaggtgcaggagccctaagtttatcttggaacctcaagaggggaggaattcacccaattcatagagtggtttttttgtttgtttgttttttggcataatctcgatctgttgcccaggctggagtacagtggtgtgatctcagctcactgcaacctctgcttcccaggtccaactgattcacctgtctcagcttcccaagtagctggaattacaggcatgtgccacaacaccctgctaaatttttttgtattttgtagagacaggatttcaccatgttggccaggctggtctcgaactcctgacctcaagtgatccacctgcattgaccccccccaaattgctgggattacaggcatcagccactgtgcctggccccaactcatagatatttgatggtacaaatctatggctgggcttggctttaaaaaagtcttatctgagattctttctatggaacaaagttccatcaatgccaatttaaaagcctatgtaaaaaataataattcttgctgcactgtatacaaataatcaggccaagtataataaagcaaatcagtccttccatgatttgtctttagtaaagatggaaaactggagagagaaaaattatgtttcaaaaactataatacacctgttgttagattccagtcttgcctaatgtttttcagttgtttttttttttttttttttttttttttagatggagtcttgctctgttgcccaggctggagtgcagtggtgcgatctcggctcactgcaagctctgcctcctggattcacgccattctcctgcctt[134 bp omitted]ggcttcccaaaatgctgggattacaggcatgagccaccgcgcccggccttttcagtttttattattttctacagtctggaccaaattctattttttcttggttacaagtcttcaagataatgttttcaatttttttccttcttttttcccccatttttcctaattaggagtcattgaaaactaagcgtgctttcataaagccctgtgaactgaagtcagacaacttaaactttagaagaaaataacagcaacccatttacatacataaaccactttcaaacctgcctactgattatggacttcagagtaatatggcttataccaattttccaggattgttcttttgtttgttgttgttgtttgtttgttttttgtttttttgagacggagtttcactctgccgcccagactggagtgcagtggcgcaatctcagctcactgctgcctctgctcctgggttcaagcaattctcctgcctcagcctcctgagtaactaggactactagttactagttagttgtcgtaattactaatgcccggctaattttttgtgtttttaatagagacagggtttcaccatgttgtccaggctggtgttgaactcctgacctcagatgatctgcccgcctcggcctcccaaagtgctggtattacaggcgtgagctaccacacccagcctgttgttgtttttctccctattttcacttcctaggatgtgaaacttcacaacctgctaaaaatgaactttcctaataattcaggacctaaccatctagaaataaaccaaccgagccataagagatcagacgaaacctgagaccagagactcattttcttctgaaatgctttctccaaaagatttttaaaaagaaaagggggggaatgtgaaaggaaataaatcttgggaccccaaaatcactaagctaaagggagaagtcaagctgggaactgcttagggcaaacctacctcccattctattcaaagtcacccttctgctcaccgagatgaatgcatatctgattccctcctttggagaggctcatcagaaactcaaaagaatgcaaccatttgtctcttatctacctaggatctggaagccccctcaccacttcaagttgtcccactttttcttcgagttgttgtccccgctttctggaccaaaccaatgttcatcctacatatgatgattgatgtctcatgcctccctaaaatgtataaaaccaaactgcactctgaccaccttgggcacatgtcatcaggacctcctgaggctgtgtcatgggtacatgtcctcaaccttggcaaaataaaatttctaaattaaccgagacctgtctcagatatttggggttcacataactcaggctttagcttccagtgtttaaaaccacaccttgagtcttcctttccaaagcatgccttccatgctagtgtgtctggatccagcctcaataacagcaaaatttgagagaaaagcttaaaaatatataaaatatccatgtaggaggcctaacatccattcatatgaaattccagaaagaaagcaaaaacaagagagggaaagaggtaattttaaaaacagaaaaaaatgtctcataactgaagaaagatctcagtttgaaagatcactgagtgggaattaggatgaaagaaaaagcctcacacctaaacacagcctcatgaaactctaaaatatcaagaataaagggatgatacttaaggcttctagaaaaagggaaaaaatgatgtacaaagaaatggaaatcttcattagcagcaatagatgtaaacaaagcaaagcaaaacaaacaaaataattttcactcgtgtccgtgcgaagagaccaccaaacaggctttgtgtgagcaacatggctgttgatttcacctgggcgcaggcgggctgagtccgaaaagagagtcaggaaagggagaaagggagataggggtggggccgttttataggatttgggaaggtaatggaaaattacagtcaaagggggttgttctctggtgggcaggggcgggggtcacaaggtgcttagtgggggagtttctgagccaggagaaggaaattcacagggttaatcactcagttaagatggggcaggaacaaatcacaatggtggaatgtcatcagttaaggcggggcagggccttttcacttcttttgtgattcttcagttacttcaggccatctgggcgtatatgtgcaagtcacaggggatgcgatggcttggcttgggctcagaggcctgacattcctgccttcttatattaataataaaaataaaacaaaatagtgttgaagtgttggggcggtgaaaacttttggggcttggtatggagagagaatgggcgatgtttctcagggctgcttcaagcgggattaggggcggcgtgggaacctagagtgggagagattaagctgaagggaggtcctgtggtaaggggtgatattgtggggatgttagaagaaacatttgtcgtatagaatgattggtgatggcctggatacagttttagatgaattgagaaactaaatggaataagagaaggagaaaaacaggtataaaaggtctaagaattgggaggacctaggacatctgattagagagtgcctaaggagattcagcatagtcccgccagcaaagattatttatttacttcaagagtttagagtggcagtttggggatagcaccaggagatatcagctgtgatggcttggaaaagcagtgtaaaccggcagtgtaaacaagagcagggcatgtatgagtagttgagaacggtgaataggagtatgactagacagaagatagtagggatgacaagttttttgggggcacagtctaagttggtctggtgtctggaatgagactggggcctaataaaaaggagcgtctatacaggagcttaaatgggctgtaccttgtagcattctgaggacaggcctgaattctgagaagctaaaatggtaaaagtattgtccagtcctttttaagttggtggctgagcttggtgaggtgtgtttttaaaagacctttagtccgttctacttttcttgaagacagaggaccgtaagggatataaaggtttcactgaatactaagagcctgaaaaactgcttggctgatttgactaataaaggctcagctgttatcagactgtattgaggtgggaaggctaaactgaggaattatgtctgacagaagggaagaaatgactatggtggccttctcagaccctgtaggaaaggcctttacttattcagtgaaagtgtctatttagactaagaggtattttagtttcctgactcgggacatgttgagtaaagctaatttgccagtcctgggtgggggcaaatcctggagcttgatgtgtagggaagggagggggcctgaataatccctgaggagtagtagaatagcacatggaacactgagaagttatttccttgaggatagatttccacgatggaaaggaaatgagaggttctgagaggcgggctagtggcttgtactatatagcatagcctgcctttgctggtgtgtggcgattaggcctgatggaactgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaagtccaggccaggaacaatggtaattgtgggacttaaagagtgagtacagctgaaggagccggggagcagaaagtatatgcgtcaggtatgaggaagaaaatagattttggaagttatgagacatgtagagagtgaggtgagcatagtttgtgatttttagggcctctaacagtattaaagcagcggcagccgctacatgcagacatgcgggctaggctaaaacagtaaggtcaagttgtttggacagaaaggctacagggtgtggtcctggctcctgtgtaagaattctgactgcactaaccatgcctaggaaggaaaggagttgttcttttgtaagggattgaggtttgggagattaatcggacacgatcagcagggagagcacgtgtgtttttatgagaattatgccgagataggtaacagatgaggatgaaatttgggcttgattgaagtaatgggggctgtctgtgaagccttgcggcagtacagcccaggtaatttgctgagcctaatgggtgtcagggtcagtctaagtgaaggcaaagagaggctgggatgaagggtgcaaaggaatagtaaagaaagcatgtctgagatccagaacagaataatgggtagtagaggaaggtattgaggataggagagtatatgggtttggcaccaaggggtggataggcaaaacaatttggttgataaggcgcagattctgaactaacttgtaaggcttgtctggttttaggagaggtaaaatgggggaattgtaaggagagtttataggctttaaaaggccatgctgtagcagacgagtgataacaggctttaatcctttcaaagcatgctgtgggatgggatattggcattgatcggggtaagagtgattaggttttaatgagatgttaaggggtgcatgatcggtcgccaaggaaggagtagaggtatcttatacttgtgggttaaggtgggggatacaagaggaggacgcaaaggaggctttggattgggaagaagggcagcaatgagatgtagctgtaatccaggaatagtcagggaagcagataatttaaagtgtctcggcctaataagggaactgggcaggtggggataactaaaaggagtgcttaaaagagtattgtctaagttggcaccagagttggggagttttaagaggtttagaagcctggcggtgaatacctaacaacagttatggaggcaagggaaacaggcccttgaaaagaaggtaatgtggagtgagtagcatccatattgattaaggggacggacttaccttccactgtgagagttactcgaagctcggcgtctgtgatggtctacagggcttttgaggtgatcgggcagcgtcagtcttcagctgctaagccgagaaggagtcagtcagagagccttgggccagagttccaggggctctgggagtggctgccaggtgagttgaacagtccgatttccagtggggtcccgcacagatgggacatggcttaggaggaatcctgggctgcaggcattccttggcttggtggtcagatttctggcacttgtagcaagctcctgggggaggagtttctggaggaacgcctggctgctgcggttcaggcgtttagaagttcttgtgtgctggagatgtggctggggtttgtctcacagtggaggcaaggaattgcaactttttttttattattgtacaccttgaaggtgaggttaattaagtcctcttgtggggtttgagggccagattccaatttttggagttttatttaatgtcgggagcagattgggtaataaaatgtatattgagaataagatggccttttgaccttttagggtctagggctgtaaagggtctcagggttgctgccgaacgagccatgaactgggctgggtttttatatttgatgaaaaagagcctaaacgcttctgatttgggataaagaaaaaggagcattaaccttgactatgcctttggctccagccacctttttaagagtaaattgctgggcaggtgggggaggcctagtcacagaacgaaactgtaagccggaccaggtgtgaggaggggagatgataaaaagattacagggtggaggagcggaggctgaggaagaattggaacctagcttggcctggcgaggaggggagaggtcagatgggtctgtagaaaaggaagattagagagactcagcgacgcttggggttgggactgaggggacaggtgggagggaaagaaggaagatttgggacgagttgcactgggcacagagactaggaagggactgatgtgtaaaagaatgcctggatgtcaggcacctcagaccatttgcccatcttacaataagaattatttagatcttgtaggatggaaaaattgaaagtgccattttccggctatttggaactactcgagtttgtattggggtcaagcgacattgcagaagaaaataagatgcttagattttaggtcaggtgagagttgaagaggttttaagttcttaagaatataggctaagggagaagaaggaggaatggaaggtggaaggttgcccatagtgaaggaggcaaacccagagaaaagagagcatagagacacggagggaaggggttcaggggttcttaccctccagaaaagcgggaagggtggttggggcatggaaataagggattggggcacagagataagaggttggggtgcagaaataagggattggggcacagagataagaggttggggtgtggaaataagggattgggggttcttgccccctagaaaagcgggacttgctgctaagggtgaaggagaaggggttgaggggtacttgcccctcccccagaaaagcagagaaggggtagagacacagagagaaggggttggggtacttgccccttccccagaaaagcaggacttgccactaagggtgaaggaccaaggcaggcatccctgtgtggtctgacacctttgaaacatgggtgaataatcagagaggcgtccctgcaatgattaaacacctagggaaggctgccttcccagtccatgaccggcgccggagttttgggtccacggataaaacgtgtctcctttgtctctaccagaaaatgaaaggaattgaaattaagagaagggagagattgaagggtggcaccaagattgaaaggagaaagaggttgagggatagtgagggaagctggagaagagagtaaaaagaggccgcttaccagatttgaaattggtgagatgtttcttgggctggtcggtctgaggacctgaggtcgtaggtggatctttctcatggagaaaagagcaggagaacaggggattgatctcccaagggaggtcccctgatccgagtcacggcaccaaatttcactcgagtctgtgtgaagagaccaccaaataggctttgtgtgagcaacatggctgtttatttcacctgggtgcaggcaggctgagtccgaaaagagagtcagcaaagggagataggggtggggccgttttacaggatttgggaaggtaatggaaaattagtcaaagggggttgttctctggtgggcaggggcgggggtcacaaggtgctcagtgggggagcttctgagccaggagaaggaaattcacagggttaatcactcagttaagatggggcaggaacaaatcacaatggtggaatgtcatcagttaaagcggggcagggccttttcacttcttttgtgattcttcagttacttcaggccatctgggcgtatacgtgcaagtcacaggggatgcgatggcttggcttgggctcagaggcctgacaataatacctgtgaattttgagggaaaatgaccttgaacctagaattctatattagtcaaatataagaataaaaataaaaagacatgtttaggcatgagagaactcagaaattttacccctagccctcttctctgaaaaaaattacttgaggatgtattctaacaataaaaaaaaaaagagatccaagaaagagaaagacctaggatgtaagaaacagagatgataacccaggaatgcaatgaaaaaaaaaatcctaaaatggtagctgtgaaggagtgaggcatagaaagagtgggtatatgttagagcatttaacaagtcgtctatgtgaacaattggaaggtatcagtaatatggtgacaaaggcacctatatcttctgccaaaaaataattagaaattttaagaaaggaaaactttcccaaaaagtcatgatccatatatcaaacaatctaaaatgtggcataactcagcaattggagtgtaagaaaagaaaaaccatttgaactggaaatttgtactatttcccttcaagtggcctaggtatagggatacaggattacatctcctccagtgatcaaatcacacattctgttttctgcaactaataacatttacaaaattataattttgtaagtgatgtttattggctttcagaatcaacctatagaaaaagtatgaaagacaaatatagttatagaatggaatgtaaatatgaaaatggtttaaactttaacaatgttaaagtactcaaataaccaggaggagtggggagtaatttcttcatttgacacagtaagcctcaagaagtaagtgtaaatggaagcttaagtacattatgcaaagtgttaatggtaaacaattgaggagctaacaaaaaagaggaaagtcaatactgcttaaaggaaataaatcaagatttcaaagtaaaagcatcttattaagaattatggaaataaccaacagaaaaaaaaatcccagaaatggtcaaaagaagctcaaaggtatcaaatgatactctgattagtaagactgagggtaagagcaggaagaatctttgtacttttaattttgtaacctcccacatagctattccattcagtcattcattccttcagcaaatacttatagaacattattattgtaccaggcatgattcgaagcacagggatacaggatagacaaggcggagaatattcctgccctcaaggaactcatattctagtgggcaaaggtatacaatagacaagtaaattgtttccccaaaaagataggtacaaatattaagtgcaatgaaaattataaaacaaaataaagtgataataacttgagtgatcagggaaggcctctctgaagaagtaaaatttgagctaaaatacttttttatatgagaaacgtataggatttcttttcttttttttttttttgagacagagtttcactcttgttgcccaggctacagtgcaatggcacggtcttcgctcaccacaacctccgcctcctgggttcaagcgattctcctgcctc[134 bp omitted]cttcctccccagcaaccagctcaacaaaccaaggaatttgcggagaggcagtctttgtcaaaccacaaaagatcttgttacacccttagcccaaagcaataattacctacctgcctcagatttacccagagagcatttccaagtgattgttcccagcacaaggaagacatgctgcaaagtgacttgttggaaaatgttcaagtaccactttctttccctatgattccctaacccgtgtccagcagcaccaggaagagatccaggctcatctcaaggtggggtctccagagaagcatagtgaagggagacccactacataggcagaactgcctgttcatacctgacagcaaagccctatatgtaggtcctaagtctgtgctacgatgctattgtagctcgttaccaatgctcttttgaaacacacagcatgaagcaccttgacttactcaacatcctgtactacactgaggcatgtttttggccacaggaaaacaaaaaaggctaaagaagctcaacagagctaccccatcctccctcaatcaccaagcattcctaggagacgttccttacattcctcaccaactctctgccaactgtggtcatagcataataatcattgaagtcaacaccttcatgagaacaacccactttctctcttcagctggaccactttctgccccagttatctctaccttattcttcagagacataattgttccacctctaagacagcctaccctgtaacatctgactggggagcccaatttgtgcaaagtttctatagagcacacttctgatccaccatgtccaaatccacttgtccattgcccacaacaatcaaactgaacaacagccagatagattttggaggagacttctggttgtcattcaccttcaacaaataagataactgggacacacacctcccaaatgctaaatttgcttaccatactctgcacccatctattagaggaccctttttcatagtcattgcagctttctttctcataccaaccagctgcatcaccatcttttgctttcggtcaacagatgtcaattatctattatgcaccagacactgtactggatgtgagggtcatggctgcccataggccatgaggtgactgcgtgcaaatttgaaaaaggctctccagatgcacacctctgcaccaggttgcatgaattggtgagtacagcgaaggctggatttcaatccttactgatcctctcaaccagattcccttgtacagtgaacaattgtacccagcaggcatatggggattgaacaataagagtcttgtggctaactggaagcattctagattcccccaggaaggccaaagggacatctgcattttccaaatatttcatcaagttctcctactacagtgtctgctccacctgctgctattacatacccaaggaccactcccagggcccagttacatatctggagattatgaaccctgtcacctttgcctccagcttcccctttttcatgtatacccacctcatctttcaccattcctcactagactcagctggcctcaactccacccagcacctcactgtgtactttatacccataggatccaatgttgcacaataagaaacccaaaagacacaatacgggaaattttggagcaagacactacctccagtactgatcttacctcaccccatttagcagggaggaagtgaaaggcaggaggggacatgtccaatcctgctctttcttaggctgatcaagtcacccccaaatagatggccaacctctactgagaggggccttcacatccctctgccttggccaaacactgtgttctttgtacctcattcccagattgagccagctgaagcaaaacccagtgaagaccacctttaccgttttttaatagaatacataaaaccccagtctacagcatctgccttccccttttccaccaccatcgaggaacactggcagataggtaacttactaagaggcctcaatgaagtggtctgtcccagagaaagggcaggtttgacccaagacaaattccagatcctctgcttagagccgcaggaagaaatgctgaaaccaaaccaagccaaacaacagaaaccccagcagtctttcatctgctctaaatctagatgatttcaaaagtgtgtccatcatgaaaagatccctaggggtttgcttgtactagaagagcataaacatttacattgccttttttctgctgacagaacagtgagagggaagggcctcatctggcaacttaaagcaataccattcaatcatcccaaagccagttctttgtgtatgtaagtagctgcccttgcaggaggcttaaggtgctgggagctcagggtcctgagtcaaatgatctggcttcaaatctcacctctaccacttacagtttgaactataaggaagctgtatggtgttacagaaagtacacaggctctggacacttggctgccaagtgtaaatccctgctgccccacttaccagctgtgtggcctttatgatatacagtgcctcagtttcctcatctctgagatgatagttatactccctgtaacatcacgggactgttatgaggcttacatgggaccatccacaacctcacctacagtaaatgtttactaaatcttagtgattattattccattctgagtctatttctcattccttgaaaatgagaagagaaaggggcactgctctgcataatcatgtgaggcaccatcgcccctgtgagctgggaaagttgggagaaggtttcttttcttccatttggatttagacggcattctctctgagaatctgttgtttagcctgaagagatagacgtgcgtatgtgtttcatccaaccatcacccacgggatatcaggaaaaacaaaaaagcatttatctctctgtgacccctactgatggggacctttggaaagcgatgacacctggaatgccagagcctaccctaacctgtccatttggaaggctcagagccatatgccaggctgaataactaagatgtgggccagtgggcttctagggaagatagaggtgggacctggggcaagaccaagccctgtgagtaggtagtgggtggagcttcatttgatgggttgaaagaagaggaaaaaagtgaagctgaattcaaggaagaagggcatgagggttctctctgtgatgggcctctctggtgattttctcttggtctacagacatggacatgggcagtagattattttttaaaagtccccatacttgaaattcctttcagttattcacaggccttctgcaaaatctgtacaaccctggtggtgatgttgggaagtataaatgagaggacagtataggaatgtatggtgtcccctcattcactcaccagtgtctgtttatccttcttagaaggggacttgagtgctggatttctggaggagatcagtggaaaattgagtgttggtccatggaacagcagagaagagtagccgccagatgaatggctcagggagggatgtgggcctaaccctgtactttgtgatatgtatactagaagaaaatgactggtaaaggaggaacagcgagatgacattggagctattgtgtatctttgggtgtgttacttaacatcctggtgcctcagtttcctcatctgaaaaatgaggataatgatagtacctagcacataagactgttatgaggataaaatgagttaacatttgcaaaatatttcagtgaccagcacacgttaaccatattagaagtgtttgttaaataaaattaaagttcaactgacagaagtgtggagtgactgataaatgatatattgaaaatgcagagctgggcagtaaaaatttatcttcctcttcaggggaaagacacaagtattctggccacgagaatgtgtactccaatatggagcagggggccagggctccactgctttccatgttaagcttattttcccacagaggaccagactccaccatggtctaatgcacatttgtttcccgtccagccagaatacaaagcagaaaggtgattccaaccccaagtgaagaagaatttccttcttgaaatacccttgcacatatgcacaaacatacatcaacaagggtgttcactgcagcatttcttgtaatagtgaaaaacaggagccaatagaaattacaactaacaaggactggccgactgataaagattaaaccaaaaaaaaaaaaagaggtgcatgtatgtggatgtgcactgataagtagccaaaatatactgtttcatgaagaaaatagaagcagaatagtatgaataaatgtcatcttgttaccagtggaggatatccaggttcttggcattttgaacaaagaattggacaaaatgcataaacaaagcaaggaaagaatgaagcaacaaaagcagagatttattgaaaacggaagtacactccacagtgtgggagcaggctgagtagaggctcaagagccctggatacagaatcttctggggtccaagtaccccctagagtttcccattggacactttgtgctcacctcatgtaaataaagtggtggcccgcaatcagtgtgattccaatcagaggctgaagtgaagttacaaagttacacccaattagtattggttgcagcaaccaattaggggctgaagtgaagttgcaaagttgccctcctatgcaaaaagcaaccaatcagaggtactttcaatttcccatctgtggtgcagaaaaggtgggggtttgcaaaggcagtagcctctggtccttttgttacttaggcgtggaaagttagggttttcctttcaatttagttctaggaagtcagcatgaaacagctttaggttccctgcctccagacgttattctcctgcctcaatctcatctgtggggggtgtgtgtgtgtgtgtgtctgtgtgtgtgtgtgtatccctttcagacacacacacacacacacacacacacacacacacacacacggtgtttatccacccagcaaaaactcctgggtggataaacaagaaaatggtaacagtggttacccctgcggaatggagctgcggatgagggtaaagggaaaggagatttcacttgaattttgggagtttatttttattttggcttattttcacaataaaactagttttttgtgttttttttttctgattatataagcaatatatgtttattctttttttcatattttaacttttgatttggaaataatttcagacttataaaaaacttgcaaaaacagtacaaagaattcaaatatctgccccctaccagcttcccaaatgttaacatcttatataaatcaaacccaggaaattaacatcaatatgatactattgactaatctagaggctttatgcagaagttgtcaattggctcactgctgctctttttctggtctaagatccaatccaggatcccacattgtatttacttgttatatttcctcggtctcctgcagtctggtacagcttctcggtctgtctttgtttctcatgacctggacactttagaaaagtaacgcctagttattatgcagaatgtctctcaatttaggtttgtctcatgttttcttatgactaagtacaggttatgcatttgggaaaagaaaatcacagaattaatgcaaggcccttttcgctgcatcctattaagagacacacaatgtatatgtctaattactggttatgttaactttgaccacttggttaaggggtgtctgttgggttgctccactgtaaatttactccttttcttttccaaattagtttatagcttgtggagagatagcttgagcctatatgaatatcctgtttctcatcatactttgcccactaaccctttgatgattcttgcctaacacaattattactgtgatatttgtcaaatggtgattttctatttccgtcattccttctacatttattaattggcattctactgtgagaaagtgctttcccttctccctatgtatgaattcaattatttatttatgtaactatggacttgccaacagaatgtattgccgtactttttaatttttgctgatctgatagggggaaatgatatcctggtgttgctttaattgcatttacctaattatatgtaaggttacaaggttaaggagctatttactgatgatagataattgtctgttcacgtatttctccattttcctattcagttttggggacctatgcccatcaattttgaagcattatttgtagagtcacaattttagcccctttatctgtgatgcatattgcacatatttgcttccagtttctcagttgttttttggtgttgattatgatgaggctttttgccatggaattttaaaatgtagtcaagtttatccatttttttcttttattgcttctagattttgagtcatgattaaagagcctttccctacaccaagggtaaaagggaatttgttcacattttctttttttttttttttctttttttgagacaggatctcactctggctcgagtgcagtggcgtgatctcagttcactgcaacctccaccccccaggctcaaattgagaggtgacagcgtgctggcagtgctcatagccctcacttgctttcggcgcctcctctgcctgggctcccactttggtggcacttgaggagcccttcggcctgccgctgcactgtgggagcccctttctgggctggccaaggctggagccaactccctcagcttgcagggaggtgtggagggggaggcgcgagcaggaaccggggctgcgtgaggcgcttgcgggccagctggagttccgggtgggcgtgggcttggcgggccctgcactcggagcatctggccagccctgctggctccgggcaatgagggacttaggacccgggccagtggctgtggagggtgtactgagtcccccaccagtgccagccgaccggcgctgtgctcgatttctcaccgagccttagctgccttcccgcggggcagggcttgggacctgcagcccgccatgcctgagcctcccacccactccaagggctcctgtgtggcccgagcctccccgacaagcaccaccccctgctccatggcgcccagtcccatcgaccacccaagggctgaggaatgcgagcgcacggcgtgggactggcaggcagctccacctgcagccctggtgcgggatccactaggtgaagccagctgggctcctgagtctggtggggacgtggaaagtctttatatctagctcagggattgtaaacacaccaatcagcaccctgtgtctagctcaaggtttgtgagtgcaccaatcgacactctgtatctagctgctctggtggggccttggagaacctttatgtctagctcagggattgtaaatacaccagtcagcaccctgtgtttagctcaaggtttgtgagtgcaccaatcgacactctgtagctagctgctctggtggggatgtggagaacctttatgtctagctcagggattgtaaatacaccaatgggcactctgtatctagctcaaggtttgtaaacacaccaatcagcaccctgtgtttagctcaaggtttatgagtgcaccaatcgacactctgtatctagctgctctggtggggccttggagaacctgtgtttccaaactctgtatctaactaatctgatggggatgtggagaacctttgtatctagctcagggattgtaaacgcaccaatcagtgccctgacaaaacaggccactgggctctaccaatcagcaggatgtgggtggggccagataagagaataaaagcaggctgcctgagccagcagtggcaacctactccagtcccctttcacactgtggaagctttgttttcttgctctttgcaataaatcttgctactgttcactctttgggtccacgctgcttttatgagctgtaacactccccgtggagatctgcagcttcactcctgagcccagcaagaccacaagcctactgggaggaatgaacaactccagacgtgctaccttaagagctgtaacactcactgtgaaggtctgcagcttcactccagagccagcgagaccacaaacccaccagaaggaagaaactccaaacacatctgaacatcagaagggacagactccaaacacgccaccttaagagctgtaacactcactgcgagggtctgcggcttcattgttggagtcagggagaccaaaaacccaccaattccggacacaaaatgatcttctcacctcagcctcccaagtagctggtacccaggtgtgtgccactcagaggtgacagcatgctggcagtcctcacagccctcattcgctcttggtgcctcctctgcctgggctcccactgtggcggcacttgaggagcccttgagcccaccactgccctgtgggatcccctttctgggctggccaaggccagagccggctccccaacgtggaaggaggtgtggagggagaggcaccagtgggaaccggggctgcacgcagcgtttgcaggccagctggagttccgggtgggcgtgggcttggcgggccccgcactcggagcagacggctggcccggccggccccgggcaatgaggggcttagcacctgggccagcggctggggagggtgtactggggcccccagcagtgccagcccactggcgctgcgctcaatttctcaccagggctgagctgccttcccgtggggcagggcttgggacctgcagcccgccgtgcctgagcctcccaccccctccgtgggctcctgtgcagcccgagcctccccgatgagtgctgtcccctgctctactgcggccagtcccattgaccacccaagggctgaggagtgcgggcgcatggcgcaggactggcatgcagctgcacctgcagtcccggtgcagaatccagtgggtgaagccagctgggtttctgagtctggtggggacgtggagaacctttatgtctagctaagaaattgtaaatacaccaatcggcactctgtatccagcttaaggtttgtaaacacaccaatcagcaccctgtgtctagctcagggtttgtgactgcacccatcaacactctgtatctagctactctggtggggccttggagaacctttatgtctagctcaaggtttgtaaacacaccaatcagcaccctgtgtctagctcagggtttgtgaatgcaccaatcgacactctgtatctagctactctggtggggacttggagaatctctgtgtccacactttgtatctagctaatctggtggggacgtggagaacctttgtgtctagctcagggattgtaaacgcaccaatcagtgccctgtcaaaacagaccactcggctctaccaatcagcaggatgtgggtggggcagataagagaataaaagcaggctgcccgagccagcagtggcaacccgctcgggtccccttccacactgtggaagctttgttctttcgctctttgcgataaatcctgctgctgctcactcttttggtccacactgcctttatgagctgtaacactcaccacgaaggtctgcagcttcactcctgcctgagccagcaagaccacgaacccaccagaaggaagaaactccgaacacatccgaacatcagaaggaacaaactccagacgcgccaccttaagagctgtaatagtcaccgcgagggtccgcggcttcgttcttgaagtcagtgagaccaagaacccaccaattccggacacaccaccactcccggctatttttgtgtgtgggtatttttagtagaggcagggttttgccatgctgcccaggttggtcttgaactcctgactcaagcaatccacccatgtcagcctcccaaagtgttgggattacaggagtgagccactgcgcccagcctcttttaatatctgtatagtttcatgtattacacttggatccttgatccatttagagttaattcctgtgtgtggtgtacagattggacctcattttatatttttccagataactagtcagtatacccagcaccttttacaaatctttgtcccagtaacatatatttattctttaaaaattctggtgataaatacaagtttaaggaagaaaaaaatcacaaacaaatcctacccagagataaccgcaaattatgttttggtagactgctctggtttaaatatttgacccctctgaaactcatgttgaaacgtactccccaatgtaacagtattaagaggtgaggcttttaagaggttattgggtcatgagggctgtgccctcattaatggattaatccattcatggattcatgggtaatcatgggactgggtctgttataaaagccagtttggcaagttcttgtcctctcaccatgtgatgccctctgccatattatgatgctgtaagaagtcccttaccagaagtggtccctcaaccttggacaaccagcctccagaactgtaagaaataaatttcttttctttgtaaattacccagtctcgggtactcagttatagcaacaggaaacagattaagacaatgaccatacttccctacctttccctattcatacgcgtgcgtgcacacacacacacacttttacaaagatgggatctcatacatgctgtttttatcacgggcatgtttattcacacttttttttttttgccccatccctaaacataattaacagcctgttatgtgacttttagcacctttagtcatgtccagttattcatatacaaacctattcatacatgcataggctgttcttgttgtttgctttacaaataacaaaacgggttcatactgtatatgcttctcagcattgtatccttgctgcttaatgaaactttgaggaattcctctaagtctgctggtatagacttaattcctccttttttgtttttgttgttgttttttagagacaggatcttgctctgttgaacaggctggagtgcagtagtgcaatcatagcctactgtagctttgaagtcctgggttcaagcaattctcctatttcagcctcctaagtagctgggactaaaggtgtatgccaccacacctagataatttttttttactttttatttgtagagatggggtcttactgtattgcccagactggtcttgaactcctggccttaagagatcctcccacctcggcctcccaaagtactgggattataggcatgagcccatacccagccctaattcttccttttttaatggctaatagtcaatattattgatgtattattaaatactgatgggcattaactgttttcctttgccactgcaaactgagctatcactaacatccttgtacacatatccttttatagtagtgttctcatttctgtggtacttttcaacttaaactcgtctatattgtgaatttttatcatgagcaactattaattttattttaaaaagcaaaatctatcactgtatagagcttgagtttacaatcagatgcatctgaattcaaatcctctaaaactcagacactgctggtgggagtgtgaaataatgcatccactttggaaaaccatttggcatgatttactaaacttgagcatacatatacactgtgagccagcaaatttacttctaagcatatccaacacaaatacatgcacatgtataactcagagaagtgtccaaagatattcttatcacttctatttgtaatagctcagaacagaatattccaaatgtctgacaatagtaaaaatcaatagattgtagtatattctgacaatataatgctgcatagcaccttttctcaaaaatgtgatctgtggatctctgaggagtccccaaaacctttacaaggggtcctcaaggtcaaaatcattttcataacactaaaaggatatttgccttcttcattgcattgacacattgacatttgtactgatggtgcaaaagcaaagatatatatattgccagcacctcagcacaaatcaaggcagtggtaccaactgtactggtattcatggcattcttcaccctacacactcagtaaacaaagtccttgatgaagaagtaaaaatcaattctatcaaatctaatcattgggtacattgtccatatgatgagctaggaagcatgcataaggcacatctgttacacaccaatgtataatggttgtcttgaggaaaagtacttgttagagttgtgagctgaactagacaattttgtcatggaaccctatttttacttgaaagaatggctaacagacgaactacagttattcagatttaggcttttggcagacatttcctggaaaatgaacaaagtgagtctgtcacttaactagcagtatatgctaccaatgataatattggagctttctccaggcacagttcctcacgcctgtaatcccagcacttcgggaggctgatgtgggaggattgcttgagcccaggagttcaagaccagccccagtaatgcggtgagagcccatctctaaaaaatacataaatgaataaaatatatgggagctttcaagtaaaaaagagaattttagaaaatctgtatgagcttgacagcgtccccatgcttaaagactgtcctgatgaggtctgtggtaatagtaacaaatgtgattttttaaataatatatggcaaaatctgttaatatttggaaggtctgcctgcatacctcagtaaaacaatattttccaaaagcatattgttacaaaattaagcatgggtaaaagattaattcaaagtacgagataaattaatggatttttaaagcaactatattaaggaataattgacatacaataaactgcacatatttaaagtgtatgatttgataagttttgatagacgtggatacccgtgaaaccagcatcataacaaagatgatgagcatacctaaaaacccaaaaattagttcatgctcctttgtattctctcacttgcacacttctttctcttctccaaaccatccccaggcaaaccctggtctgtttcctgtc[156 bp omitted]cctgtctctactaaaaaatacaaaaaattagccaggcatggtggcaggcgcctgtggtcccagctgctcaggaggctgaggcaggagaatggcctgaacccaggaggcagagcttgcagtgagctgacatcacaccactgcactccagcctgagcaacacagtgagacgctgtctcaaaaaaaaaaatggaatcatatagtatgtgctctttttgtctagcttcttttactcagtataatcattttaagatttatccacattgttgcatgtagtatttcactgcatggatacaccacaatttatgcattcacctactgatgggtatttggtttgtttctagttgttggctattataaataaagatgccttgaacattcatgtacaagtctctgaatgtacataggctttcatttctcttcagtaaatacctaagagtagaatggctgtgtcatatggcaggtgtatgtttaacatttttagaaactgccaaaatgatttccaaatgggttgtgccattttgcagtcccaccagcagtgaatgagagttccagttgctccacatcctcatcaacacttggtatggtcagttaaattacttggaaacagtttgattcttctgggtttgcttttgtggttggttaggtgggtctgcaacagcacttagtcttggctagttatttcccattacttaggcaagacctcctgactactcaatgtcccatgaattatgagtttctccagtctgcctggagggaagaagcactatttctggccctatgtgagcacaaggcacagttccctctaatcatgtcagatggttatttgccacccttgagtagttttctcacacatacatgctgatcagtactctgctgaatactctaggtctttcttagagtagctctttcctctctggtgttctgtcctatgagctctcctttcttggtctcccttgaccttcagttctgtctccttaattcaaggaggtccaccaggctctacttcagtacccttccctatgtcactttctgaaattttctcaaggaaacagactaaggttatcatagggctccccttgtttgttcccatctctctgggattactgtccttcattgcctaacgttcaatgtcttaaaacccattgtttcatgcaggagggtatacctgggttctgttactctatcttggccatgaaacctaagtctcccattcttttttcagtccaggaaactgaggcccagaacaacaaattggcttgcccaagtttttaccagttaatgaagaagccacagctagaaaccaacacctcctgacctctaatctgaagtcgagacagggctttttcttatctttccagcttcagagatggcttgacaacagaaggttaattaatcagccacagacaaagtaaatatgcatgacctatggtctctgaaaggtacagactagcctgcccacccatccttgatcaatcagcaaatatttattgtgcaccaacgtggaatgccccatatgagacattgctggggacagaaaatgatgcgccactatctctgtggacaagggctcaagtctagatgggagaaagcctgcatgtgaaacatgtccatctttacattctcatatactgtgtcactcaactccccagccaaaagaatcaagaggcatcacaatttgtgggcttttctcaggaaaggcttcccagagaagggaggacttggaatcagaatatgtgatatgcccttactgaggaggatggtaaaggcaggacattatctccctatggctcttgttaaaaatatactcataacttcagagggtctttggctatgtgaaaagcctaagctttgggataagggaagaaggtgatattgtccttaaccagagggcagactaagggatttgatggaaatcctgtggtgaggaagacgcctcatgggccgcccccgtctcctactgcagtgctatgaccagggctgcctctacgctttcttagcaaaaacaaatactcccaagtagattttttaaaatgtgagaacagactattcctgcattctttatctttttcctgtctctttccatccattcttgcttcataacttttaacaggaccattgctcttcactttagaggagataacatgttactatgtgtgtgtgtatatatatatatatatatatatatatatatatatatatgcaagtgtcttaccaggtcacgaagagctgagctgtccacttgaagctgcaggacaaacactacagacctcaggcattttaataattcagtgagcatgtattgagcacctactatatgcctggaattatgtttggggctgggtactcacaggtgtctaagactcgtggcttgctttatctagttcttggtctagaggggaagacagacacttggacaataatgacacgagtcaaattctgaaataggagtaagcacaaagtgctctgggaacatagaagagaatgatgagctaagatgccaaggcgaggaagtaggtcagtgtctgggcaggtgggcgggtgtgtgggagcaggcatttcgactgggtcctgaagaatcatcaggaatttaactgacagtaaaggagagacaaagaagggaggttattgcaggtaaaggaaatagcatgaatagtggcagaaatgtgtgtgtgtgtgtgtgtgtgtgcctgcctatctggggaatgaaatggctggaccatgggacagagtagcagatgggtctagaaacagattgaagccataaataacacactaaagggtttgccatgcaccctgaaaagtaggtcttctgcctcccaaacaagcatattattttctgccaccactcccttccctacttgccttgtctgtgccctcccattatcgtcatttcccacccaaagtgatcaactttttttttttatcacatcatgcatttacacatttaccaaattgattgggtcccttccatgtaccaatgtcatgtctccttggaacactcattcggacctgctgcttgttgaagtatgaaacccagagactgtggaactatgcatggtctccatcgtagtgcctcctgctgccatcattcctgtgctcttctggggtttggctaagacctctggaagtcagccactgcatacactgtgagtattctaacatatttgccaggactctagtttatactcaatgccatatttctcactaatctttttcttttggaaaatataattatattcactaaaatatgttatttatttatgttaacatgtaatgggttatttaattaataaatatttttaaatttttcccaggctggagtgcagtggcgcgatctcggctcactgcaacctccaccttccaggttcaagcgattctcctgcctcagcctcctgagtagctgggattacagatgctcaccatgatgcctggctaatttttatatttttagtagagacggggtttcaccatgttggccaggctggtttcgaactcctgacctcaggtgatctgcccgcctcaacctcccaaagtgctgggattataggcgtgagccaccatgcccagcctaatttctaatacagtaaatatcaatggctataacccatataagcaaaatctatttggttcctcaataatttgcatacatttaaagggatcctgagaccaaaaagtttgagaactgctgtgtaattctcaataaaaataaataaaaatgagcaactactgctactcacaacatttctaaatttcacaaacatagagcaaaagaagccagacacaaaagcatatatactattacatcccacttatataaagttcaaaaccaggaaaaactaatttatgatgttagaaatcaggatgttggttacattggggtaagaaagaggggtagtaatttagaaaggaagcatgacgcttctgggatgctgccaatgttctattccttggcctgagtgctaatttaaaaagtgtgctcaatttgtgaaaattcattggtgttaagagcacttttctgtatgtgtcatttgctttgttttttaaacattgaaaaaatatgactctgtaaatcttagctctgccattttctagccatgagttggaaaaattacttgactgtgtatcatttattcaacaaatatttcaacatttcttgaagatctatctactgctgggtactgtgttatacattacagatagccgcagtatgtaatgcacagtcccaggtttatctagtgcagtgcgagagacaattatcttagcccactttgtgttgctataaaggaatacctgaggctgggtaatttgttttaaaaatttggctcacggttctgcagacagtacaagaagcatggccatagcatctacttagcttctggtgaggtcctcaggctgcttccactcatggtggaaggcgaagggaagctagagtgtgcagatattccatggcaagagaggaagcaagagagagtcaggggaggtgtcaggctctttttaacaactagttctcaggtaactaagcaagaactcactcacccaccccagggaaggcattaatctattcctgagagacccactcccatgacctaaatttctcccattaggctgcacctcccaacaccatcaaactggggactgaatttcaacatgagctttgatggggacacatattcaaaccatagcaacaaccattaaaagtatcatcacggccgggcgcagcggctcactcctgtaaccccagcactttgggaggccgaggcaagcggatcacctgaagtcgggagttcgagaccagcctgaccaacatggagaaaccccgtctctcctaaatatacaaaattagccaggcgtggtggaacatgcctgtaatcccagctactcaggaggctgaggccggagaatcgtttgaactcaggaggcagaggttgcagtgagctgagatcgcaccattgcaccccagcctgggcaacaagagcgaaactccgtctcagaaaaaaaaaaaatcatcacgggggtgttaatttttacaaaaagagaggtacagcatgttgtagagtgtataacaatggacttaaccttacccagtgagtccaaaatgaagagatgacacttagctgaactgtgaaagacaagtaggactagtccaccaatggaatggtaagagttacttggcatctccatttggctgcctaacaggcatctcaacttatcatggtcacactgaactcttgatcttccccctctccgccctctccacttggcccaccttctcctcctgaggtgttcaccatctcaggaatagcaacttcatcctattcattcctcaggccaaaaccttcagaatcatccttaatgtctccctttctgtcacaccccatatgcagtgccagctttacctgaagctaatgaagttttagcctcaggaaccctcatattccaaggccctggaaaggcccctaggaatgtgttcacattgtcatatatttttgtaaaatttgcgacagtaagatattcttactgcagtcagttaagaccactgtatctttccattccaaatttccttccatcatgtttccccttgtattaggtgctgttggagtgaccaagaacatttttgggatcctgcttaggtgaagttgagttagggatacatttagctgggctttggcaagatacatttatgtggtttgcagtcacttccttgtgtactgcatactgctgtcccaataaaaggctggcttcctggaacaccccttacagcccatgtgctgactcacctggtatagtgacagaacagtagagaaccagaagtcataaagtcatattgtgatatgaatctgtcctatggtacttgacactggaagcatagaggtagtagaggtgacacaaggtttgaaatgtacacagccagaagctagactgtgggaaatccttctaaaacatagacttgtatgcagaagatttggctcttactgatgcctagattaaaatgggatttctcatgccaaggcaggcggatcacttgagctcaggtgttcgagaccagcttgagcaacatggcaaaaccccgtctctacaaaaaaatataaaaattagccaggcttggtggcgtgaacctgtattgtagtcccaactggttgagaggctgaggtgggaggatcgcttgagcctgggaggtcgaggctgcagtgagctgtgattgtgccactgcactccagcctgggcaacagagcaagaccctgtctccaaaaaagggatttattaactgttaagaatatactggacaatgcagcatacacaattataagtgcagcatactctgtttttttttttttttttgatgggagtatcattaaatagaattgttcataggacacagacctgtagcagtactacaagcaatgagtatgtgtgtgaagtcacgggttttatgaatcccagcatatcaaatcacgcattagatagagtatctgactcatcttttcctgacaaagtctacctgattggcataatttttctcattttatatacatactcacatttgtactttattttgtatgttttttaaacaaggccccacaaactaggtaagtttcagatcctatgtataggatatggccctgctcacactttatatctaaccagcaagtccagatggctatactgtcaaaatatgtccataatccaaccccttctcaccacctcgaatgctactactctggcccaagccaccatcatctctcacttgggtcactgtaatatcctcctgaacagtcttcccacttcctcttcccccacccacatcttctcttgagtctattctcaacattgcatagagggatgttggaataaatttaattagattatatgactattctgctcaaacccctccaatagcttcacaattcactcggagaaaaaagccaaactccataaagtggcctcccagccccttcacagtctaggctccagctgtctcttcagtaccatctcttactgtgcttgtccttgcttactccacttcagccataccatcttctttgccattcctccaacacagcatgcaagagtccccctcacaagtttgcaatgacgacttcctctccctagaatgtttttccctcagatatccacatggcttgttctctcaccttcttcaagtctttgcttaactatcaccctctcaaggaggcttacgttgaccttgccattgaaaatttcaccaacccaccctcttctgtactgtagatcctgcttaccttgctctctaccttttcttttttccatagtacttatcaccttctaaaataccatgcggtttacttaattattgccttcattaatttttctctctctcctctggctagaatgcaagctccacaagcataagaatctttattttgttcagtgctatatccccaatacttagaacagtgcccagcacctggtaggcactcaataaatatttgttgagtgaataaatagatgaataaagagttgtccagaaagagggaagagcatgtgcaaagatccagggatgagtgtttgacttattcaagaaacttaaagaatcctcaagtagaaagatcaaaaatgagagtggctcaagctgagtctggcaagacaggcagaaacaagaggatgaagggctctgtagaccggaataaagatactgaactttagagcaaagaaaatccatcaaggagttataaacaagggagtggtgtgatcgtagtttggagaggtcattggcagttgtgtaggaaacagattgggggtgggcggactggaggcaaagagaccagttaggaggctagaagagtagtccaggcaagagtatacaatgtcagaccagtttgggtggggacagtggatatggagagaaattgaaaaataataaaagtattaaggaagtgaaataaaaaagctctgaatatgaaccaaaggaagaaggggttttgataagaaagggatgataatctgtgctaactgctgctgtaaggttaagagaataaagactgaaaattgtctattgggatttagtgacagggaaataattggtgatcttgtcaagagcatttgccacaaaatggagatggtgaaagtcaatctggagtgtaatgccaagtgagtgagatctgaggacatggaggccactcctaatatctgcaaagcacctgacacctagtaggctctcagtaggtgccactttcctctctcccttctctgtattatgatgttgcagaactgtgacagtattgctaattaaacaaactccaagtaaagaaaacatgttaacatattaaaataataccatatgtagttaaatatttactatttctttggcatcaaatttcttaaggtaaaatattaaattcaaatattactgagggaaacagctggtactgaatattcaagctcccagaggaccacgttaatgaatcatttaaaaaactggacagcttcacatttaatctgttcaaggaatagaaacacagtcttttctcaattattgtcttatgagatgaatataaatttctgattagtctgttcccaaaatggaaatggccttttgacattatagtaataaatgtttattataaaaaattcaggcattaacttagtatataaagaagaaacagggtacagagtttcaatgttgcaagacaagaactgttctgtgggatgcatggaggtgatggctatactacagtgtgaatatacttgatgccagcaaactgtacatttacaaattgttaaaatgataaattttatgctatgtatattttaccacac[141 bp omitted]tgaaaccccatctctgctaaaaatacaaaattagctcagcgtggtggcacacgcctgtaatcccagctactcgtgaggcacgagaattgtttgaacctgggaagcggaggttgcagtgagccgagattgcgccattgcactccaacctgggtgacaagggctaaactctcaaaaaaaaggagaaggagaaggagaagaagaccctctaatcccattgcttaaatgggcatataggatttgtccttccttcattcattcagcagatatttattggatgcctgctatgtgccaagcacatgtctagatgctctggatacattagtgaacagaataatgtcctctcccttgcggaacttacttttaatgggggacaaagaaaatatataaatatacagggaagtatgtattatatcagatgtgataagtgatatagagaaaaataaggcagagaagggagataatgaatgatggggaggctgtaattttatattaggaaggtctcactgataaggtgacatttgagcagagacctgaaagaactgagggggtaagtcatgcagatatctgaaagaagagcgttccaggtagggggaatagccaatgccaatgctccaagatagaagtatgtttactccattccaaggagactagaatggagcaggttaagagagaggagcaggaaaggaagtcagagagatttgtgggagcacaggtcacataggtctctgaagggcacaaaaaaaggactttggattttactctgagtgacgatggaaaccactggagagttttgagtagaggaggaaccagataggacttggctttaaaataatcgctctggctattctgttcacattagactacaagaggacaagggaagaagcaagaagaaaaattaggaggctattgcaataatccaggcagaaaatgagggtggctgagaccagagtggtgggagtgaagatggtgagaagtactcagattctgtacagatattgaaggtagagccaacagtatttgctaaaagactgcatataaggaggatagatctaggcttgtgtggcctaacatacaatttggggggttctctcttaagaagaacaatacaaaattaggtacaaaagtgaatatttctttaaactgagaaaagaaatcacaatatattacaaatttataaaagcttacaaatactacaaacatcagaaaatctagaaaaataatttaatattaacttcctgacacactccctataactttctcatattgtaggttgcataccatttgtttccctgcccatatgatgattttataacattttctataaaaagaatagaaagataactttgtttttcctttaacatgattaaccaaaatttgtattttattgatacttctattttgttttaataaagtttttaattgccattgtaataataataagacaagttttgacaagctagtcttctttctttcagtttacatatttggctttcttccttcctatcatatttaaatttaggttcatcaaaaatctgaagaacaatacaaaattcatctgaaaataaggcatttataagaacaattgcagtgtattgaaaaatggacactgcattgtattgagttatgtaattatataatcaaatcacttttaatactgcatacattgagttactgattaatatgtttaggctttttgtgattggaacacttgtttcttcaggttattttcctgtgttcgtgacaattgcatatgccatttcatctgaaactgccagtcttcatcagaacaagatgagtcagatacactaaaacatgatccaatatgttaaaatgcataaaacatgcaaattcatacatagacaaaaatcatgatttataatactgctacaggcttatgctctgaaaacaaagcatttctgataaattctatttcacaagatttcctggaaaacagtatggcagttcctcagaaaatagaattaccatgtgatccaacaatcttacttctggatatttatccaaaagaattaaaattggggtctcaaagagatattacctctcccattttgactgcagcattattcacaatagccaagatgtggaaacaacctaaatgtccatcagtagatgaatggataaaaaaaatgtgatatatacatgcaaaggaatattaaccaaccttaaaaagaaggaaatcctgccatatgtgacaacatggatgaacctgtagggcattatgctaaaggaaataagccaggcagagaagcaaaactactgcgtgattccacttatatgtggtatctaaaattaccaaacttggctgggcatggtggctcatacctgtagcactttgggaggctgaggcaggaggattgcttcagcctaggagttcaagaccatcatgggggacatagtgagaccccatctctacaaaaaaagaaaaaaaaatctgagcatggtggcatacacctgtagtcccagctactcaggaggctgaggcaggaggatcccttaagcccgggagttcgaggctacagtaagctaggactgcaccattgcactctagcctgagtgacagagtgagaccctgtctctaataaaataaaatagttaaactcacagaagcagagttgaatggtggttgccaggggcttatgggaaagggaagtggggagttgttcaacaggtatgaagtttcagttcttcaggatgaagattttctagagctctgctgcaaaacattgtccctccagctagcaatactgtattgtttagtttaaaatatattaagagggtagatcttatgttaagtgttattaccacaataaaaaccatatgttatgcttatagttacacatgttgcattattgagtatattagtgacagaagaaaactcccattccgactaggcggaactgacttctccatatatagttttacatgtccagtgaataattttccacagactagtttctggctctgtacattccaaatctatttctcctcagctacacatattcccaatgctgggtgctataggaggcggtagtatttgagatatgatctttggccctgcaccactagccagcatagtaaggtaattgaggtgagagtatttctggaagccactcctatgctgagatggttaacagtggtatagaggtgactgccagccatggaaatatatctgatcaaatcaaaaataaatgtaaacccaattcaatttcccctctgcatgatcccaacaatgttcacagccaccccaatgccaatcccgccatgaaggaagagtgatacaggggaagtcagagtgaagagacagctgtcttaactgattgtaattaaaatattttacttttgcaaattttacaaaagcacatgactgtgttaccccaccgtaaggagccttgtgtctcgtaaggggctcctgcaagtgagcggctctgatgcttaagcttcattagcttcacagtaaatttggtactagatgtggagtgtgtgagagagaggagtcaaggatgatgccaaggtttttggtctgagcaactgggtgagtgaagttgtcatttcctgagatgtagaagactaacagaagataagttatggggatgaacatctgaagattcagtttggaacaggaaaagtagtttaagatgtctataacacagctaagccatgtcaagtaggcagttggatgtatgaatctggagttcaggagagaggacttgctgaagaagtaaattaggcagacagcagcacatgggttatatttgaagccatgagattagataggagcaaggagagtgagagaaaataggtggaccaagaccaagcccttgggaaattctaatgttggagaagttggggaaaagaagagggattaataaaagagacaaagaaaggaaccaatgtggtcaaaagaaaccaggacagcgtgaggtcctggaagccaactgaaaaagtgtttcaaagtcggagtgatcaactatttcaagtaatgttaggactgacagttgaacattagattttgcatcaatggtaatggagaagttgcccagaggtggttggagtgagtcaaagagagtggacagaataaacaacctacagaatgggagaaaatatttgcaaactatatatccaacaaaggactaatatccagaatccacaaggaactcaaatcagcaagaaaaagcaaataatcccattaaaaagtgggcaagtgacataaacagacacttctcaaaagaagatacacaaatgtcccacaggtatatcaaaaaatgttcaacatcactaatcatcagggagatgcaaattaaaaccacagtgagataccatcttaccccagccagaatggccattattaaaaagtcaaaaaacaatagatgttggtaaggatgcagtgataagggaacacttttacactgctggtgggaatgtgaattagtacaacctctatggaaaatagtatggagatttctcaaagaactaaaagtagctctaccattcgatccagcaatcccactacttggtatctacccaacaaaaaacaagtcattatattaaaaagacacttgcacacatgtgtttatcacagcattattcacaattgcaaaaatgtggaatcaacctaagtgcccatcaactgatgagtgaataaagaaaatgttgtctagtcacaatagcaaagacatggaatccacctaaatgcccatcaatgatagactggataaagaaaatgtggtacatatacaccatggaatactatgcggccataaaaatggaataagatcatgtcctctgcagggacatggatggaactggaggccattatcctaacacaggaaaagaaaaccaaataccacaaattctcacttataagtgggagctaaatgatgagaacacatggacacatagaggggaatggcatacacaggggcctattggaggatgaagggtaggaggaagaagaggatcaggaaaaataactaatgggtactaggcttaatatctgggtgatgaaataatttgcacaataaactcctataacacaagtttatctgtgtaacaaatttgcacatgtacccctgaacttaaaataatttttttaaaaataaataaaatgtggcatatatacaccatggagtacaaactactcagccatcaaaaaagaacaaaataatgtcttttgcagcaacttggatgaaactggaggccattatcctaagtgaagtaactcaggaatgggaaaccaaaaaccacatgttctcccttataagtgggagctaagctatgggtatgcaaaggcatacagggtggtataatggacactggagactcagaaagggaggagggtgggagaggataaaggaggaaaaaaattacctattaggtacaatgtacactatttgggtgacaggtacactgaaaaaccaaacttcactgctatacaattcatccatacagcccaaaaccacttataccccctgtgttagatcattcttgcattgctataaagaaatacctgagactgggtaatttataaagaaaggaggtttaatttggctcatggttctgcaggctgtacaggcatggcaccaacatctgctcagctcctggtgagggcttcagggagcttccaatcataggagaaggtgaagaggagccagcatatcacatggtgagaacaagagcaagagagagagggtggagaggtgctaatgttggagacatttaaacaaccagatcttacataaactcagagcgagagctcacttatcacctagaggatggcaccaaagccattcatgaggcatccacccccatgatccaacacctcccaccaggacctatctccaacactggggattataattcaaaatgagattgggaagagacaaatatctaaaccatatcaacccctaaaactattgaaatgaaagaaagatagaaataatctaaagttaggttgtaattatggttgcatagctctataaatatactaaaaagcttggaatcatatagtaaaaacatgagataattattttatataaaatataccccaggtaaagcctttttagaaataaatgtcaaaaaataccagagacagtgatcatactttgtggcttggaacttgcttttctcagtaatagttcttgggatttttttcctatcagtgcatatagatctacttcattaattttaaaaattgtttagtgtaagcggtaccataattatttacccaattccctttgatggacattttggtagttatctccttggcaatcataaataatgctgcaattaatatctttgaacatatttttatgcatgtgcaaaatacagatctctgatctctggaattgctaaataacaagtatgcacattttgagttttgacacattaccaaattgcactcaattgacttttctcatcagtaatatttcagaatgcccttttgacacaccattttaagcactagatactaataatcttttaatctttgccaccccggtaggtttgtaaaaatagcaatatgattttaatttgcatgactttgatcaccagtgaagcagaacacattttaatctttatttccatttatatttcttactttgtatcacaactgggtcctttccaattttttctatttaagcttgtatctttttatgttaatcaattagttagaatcatctcatataggctgcaaatatttttttctaaatatattgtttgaatttcaacattatttatggtattttaatagagttttaaaatgtggtctatgctttcattcttttcttttaatggtttctgcctccagcatcacatctgattgtttttttttttaacaaaagccagagaaataggttttcagattattaacccaaagcttaaagagagcacgttcccttttcatagctaatcaggtatctgcaatggaaacaaaatttcccctccccattcccaactttaatcaaaatgtttttctccttatgttactgacaaaaaaaaaagccactgcctaattgagacttctgtgtattcaattaatgcttctgtgcatttggcctgacaacgtccaggggctaatgggaccatgtgctatctttaacaaagatgagagtacaaacatgagtaagacagcctattatgggctttctggggccttttaaaaatattacattttcagcatgtgaattacaccaaatggtggcaacacaggtttctggggtttaatgcatttcagttcattccatttataaagcaaaattgaaataaagtaattctattccaaaatatgttttaatcgtgagtttttgaaagctctttaggtaagatgtttttgccttgcatgatttagaaaattaactgggtttccacagtatttgaatactgcaagttgaacttactttcaatctaaaagcaggcagaagagaattttgatgtaaactgaattattcgagtaattttcttaatgattaagaagtcaactcaaaaaaacaaatgctagccactgcctatagaataaagagttatcaatccttgtttttccaaagtagtccatatgttttagaggtaaattttgaagtaaatttgaagtaaatgtccaaagtaagaaaaataaaatcgaacattcagacttcaattactgcaaaaaagatttacaaaaatctttcagatcacaagaaattgttaaaacaacagaacccaaaaacagaggagaaaggaaaaagtatgggttgtgaggttaattccagcaggtctagaattagccctagttgttttattgaagttctggcatgacactgacctcctatcaagacacaaaacatactggttaatggtgttgttttgtagccatgagtcttcagattcatggtggtttgtccgagcttgtcgacattatgtattggtaacagtgagactgattatttgtacctggtctcagtgtgacacctgtccctccctcaaagggctctactgttaaggctaaaatatgcctgtgtgactgtcaaaaaattgtttaaaacccatctgagagtccattttggactccctggttctgaggtgttctgtgcacatgtcagtggttcctggtccaagtgataaagtgcatcctgctgtcacggctcttagagaggaggacaataggatcctgtacctgaccactccagacccctggctgtatccttttcctgtagtaaactatatacttgagagtaatgccatttgagtcctctaagtctcctttagcaatggaaccctgttcacttgccatagttaatgcagcatgaaaaagtcatccaggagagtggaagagattattagtgggcatacacattgttcaaaaatagtgctgaaaaaaatggtgctgggacaaatagtgtagtagatgtgtctgcccaggtaacagtgattcttcccagagaacttctatcttctatcttctcctttccaattcataaggtttcaggagtgggtccacaacagccatgtacacattaagtgacccatgttccctagccaaagctagttggatcagaggtgaacccctgacccaagctagactgatcagagtctcttccagtctgaagggttggcatctttaagtgaggaaacctaaaagctcacgtgttgagctttggtatacacagcttccaccaacaggaccaagtagccgagaaagcccagccacagagatgaatgaagccaaggctcagagggcagcagagctgaggaatggcaacaagctactctttgcattcctgacaccatttccttctctgattccagccgtttgggagattaagctccatccaagatctgggttccagagaaatactccatattcttataataaattccttttttttcccccatcaagctagcttgagttagcacctttactagcacctaaatatccttaactcactagccatgtagaaacatatagagctagatccctacctcactgcctgcccaaaaatacattccagatggaattaagatttcaatttcaaaataaaacaatatagggagtaaaatcaaatgtaggagaatttatttatttatttatttatttatttatttatttgagaccgggttatgtgttgcctaggctgatctcgaactcctggcctcaagcgagccactcacctcagcctcccaaagtgttggggttacagttgtgagccactgtgccccagccaggagaatatttttataatcttggaatctacaatcaaaaataaaaaagatttaatcatttgcctgtatgacatttgaatacttataaacagccaaaacacagcataaacaaagccaagaagcataaaaatagggaaagtatttgtaacaaatatacaaagcaaatgactagta[136 bp omitted]catggtgaaaccccatctctaccaaaaatacaaaaattagccaggcgtggtgggcaggtgcctgtaatcccagctactcgcgaggctgaggcaggagaattgcttgaagccgggaggtgaaggttgcagtgagccgagattgcaccatcgcactccagtctgagggacaagaatgagacttcgtctcaaaaaaaaataaataaataaaattaataagattaaaaaggcaggcaaatcgacaaaggatgaaaattgagaaatcatagaaggcaagttacaaattaccagcaaacatattatatgaaaagatgttcaacctgacacttatttaagaaatagaaatgaaaactacagattggcagatattaaaaagattaatagccctagtgatgacaaggttttagaaaaacatatactgtcttttaactattgttaaaaactttttggagtgtgatttggcaatatcaattaaaattttaaatacacaataacttttgacatcagtaattccactgctgggaatttatcctacagaaaatcacataatgtgcatgacactatataataaggttgtttattataaaatggtttataataaatttggacatacacaaatgtctatcacaaggcattgcattttttaaaaatctagcataaccacagagggtaataaactgcagcagtttaaaaatattgaggcagcattgtgtgtactgacatggaaagctacttgggaaatattttaagaaaaaagcaagttgcagatcacaggaatagcatgatcttatttttgaagacgtgagggagaccatgacctgataacagtggttacttgtgggcaacaggaaaccgggaggcagggaggggggcacagaaagctgataatttttaatgtatacagttctaagtgttctaaagcttctacaacagacatttattaattttgtaatgattttaaaataaaatatttttagaaacttcagacaaaaatggaaagatagctgggtgcggtggctcatgcctgtaatctcaacactttgggaggccgaggcaggtggatcgcctgaggtcaagagttcgagaccagcctggccaatgcggtgaaaccccatctccactaaaaatacaaaaattagccgggcatggtggcgcacgcctgtaatcccagctactcgggaggctgaggcaggagaattgcttgaacccgggaggcaggtggaggttgcagtgagccgagattgtaccattgcactccagcccgggtgacaaaagcaagaatctgtctcaacaacaacaacaacaaaataatacaatttaatttaaaaataaataaatgaataataagactcaacatcaaaataggtcaattctctttcatttaaattacaaatctaacatgatcccagtaaaactgcctattctggggactagagaagcttgtttgatgttcatatggaaaataagaaagaataaccagaaaaatgctgaaaaggaagaataatggggcaggaggaacttgtcttattaaagtatatacaataaatacggatagcaaggatgtttattaaccagtgtttatattagagaccaactgtagaccactaaaatacctaccaatataagactagttaaataaaatatgatatgtccatgttgtgcaatattatgcaattattgacaataatgtagatgtattgatgtggaaagatgctcatgacatattgctaaatacaataaagcaagttgcaaaacaataaatacaatgtaatcctatttatggaagaaaggcacatgtatatatgagcacacatacattacatgtatgtaaatacatgaaaagtagacagaaattatgcccactgaactggtaacagtggttaccttcaaggagaggactgggattcagggtatgggtggtgggagggagagtagtaaggattttgttctgtatgcttctataatgtttgaatcttttatgatgagaatgattcctgtatcacctgtatactttttaaaagacaaaaaatgtctgtaatcccagcactttgggaggctgaggcaggtggatcacttaaggtcaggagttcaagaccatcctgaccaacatggcgaaatcctgtctctactaaaaatacaaaaatgcatggtggtgcaacgcctgtaatcccagctattcaggaggctgaggcacaagaatcgcttgaacctgggaggtggaggttgaagtgagacgagatcgcaccattgcactccagcttgggtgacagagggaaactctgtctcaataaataaataaataaataaataaataacaaaaagagcagttaccacagtctgcttttctgtgaatgttgggacaaactggaccacaaacaaaagtttacattcagtcacacatttatttcttcattcattcaacaaatatttcctgctgagttctaggtacttggtactcactagcgattaacagacaatgctctgatccagggcagctcatccagctgggtgattgctgaagccagctgtcagatgaggtgactggaacacaggtgcagttgatgtggctctttagaagccacatagatcaattatgtatggttaatggctactaataaaataagaagttaatgcctgtcgcagtaatgtccaaaagtgacagacaatgcgacagaggcaaaaaatctaatgattttttaatccaatgatgcaaaaagagaaaagcaagcagcagtggaaaaatccaacatgtctcttgtaagacttttacctaaagcctttctcgatctctgaaccagccacggaatcaactctgccctcacttgtactttcttcgtgtgccaaagtggaaacctacccatggaaatttgcattttccttcttggaccatggcagactcagggagtggagggtggcagggcattgccagggcagctagtggggacctcaggaaccatagatttgtggctaaatacctgaaccctcccatcctggggaggactgggatttatgtggtcagagccagagtgtgaagcttctgccagaggcagcacagtctgccaaggacctgaaggtcaggtcaagccaaagccctcaggagaaagctggggtttgatcaccaggatgacctggtgcaggcctaaatccaaagagtccaagacaaggctcagactgagcaaagaatccaacactgcttgcctggccacatctccctgagctactgatttccctcctcatgttcccctttctgtcctctgaattcaagtcctggcactggctttcctgctacagccttggcccttctccacataagtatctggctttctgcctcaggctgcctgaggaaaagccctgagacaacctagcccctgggaccctgctacccaggagtcaagcccatggcctgcactcccggcccatttgtcctgttcccttcggtggcagagagaccagcaccctactcatgggcattagaatctcactatcagacccctggcaaggccctgtctgggcagctctcccgtttcaatattgctctctggttgcaacactttgcaggcatctttctcagtgtaaatccacaaattggtattctggattcgcaatcaaccagttacaaatttaggtagggcaatcccatccctagacctgaacacttttgggagagctgacaaagtttctgaatcctcaaatttgcaaaacagaccctccacccctgggaggacccgctcaaacagccaactggtttctttctttactacctcatcactgaaacaggcagagtccaagagacgattctgaaatatagaaccctgtctaggaaggcaggcttaaggagggcctccaggaagggactgtgagcaaagcataaagtgtatgcaggtgtatggtggtggggggggcaatggcaagaaggaggaataggaataagagcgtagttaagaacgtgggtgggagagggtgggtgctgagaattacttaatagatacaatgcacattatttgggtcatggatacactaaaagcctggatttcagactgtgcaatacatccacagaacaaaattgcatttgcacgttttagatttatacaataatttttaagacaaatgtaggctctgcctgtgtttgcatctcagtccagtttcctcatttgttaaacagaatcataatatctgaagtccagtttcctcatttgtaaaatgggatcataatagtatttaccactatattatgagaattaaatgagatagtaccacggaagacttagcacaatgtccagcacataagaagcactcagtatatgccacctgttcctagaggagagagtgaggccaaggaggttccaacgggaagaaaggagaaataaatgcagggagatgagaaagactcagataagctgcctaatttccacttttttccgagggccagctttgactattttaggtgttttaccagaaatgtatttgcatcatttgtaaatttccctgtcactaccaatttccacttccagctctgtccttttttatctgtgtgtgaccatgggtaaatctcctaatcactccatacctcagtttctccaaaaatacaagtaagtggttattgtagaaaactgttcctctccctctccctctccctccccctccccctccctctccgtctccgtctccctctccccacggtctccctctccctctctttccacagtctccctctgatgccgagccgaggctggactgtactgctgccatctcggctcactgcggcctccctgcctggttctcctgcctcggcctgccgagtgcctgcgattgcgggtgcacgccgccacgcctgactggttttcgtgtttttttggtggagacggggtttccctgtgttggccgggctggtctccagctcctggccgcgagtgatccgccagcctcggcctcccggggtgccgggattgcgggcagagtctcgttcactcggtgctcagtggtgcccaggctggagtgcagtggtgtgatctcggctcactacaacctccacctcccagccgcctgccttggcctcccagagtgccgagattgcagcctctgcccaaccgccaccccgtctgggaagtgaggagcgtctctgcctggccgcccatcgtctgggatgtgaggagcccctctgcctggctgcccagtctggaaagtgaggagcatctctgcccggccgccatcccgtctaggaaatgaggagcgtctctgcccggccgcccatcgtctgagatgtggggagcgcctctgccctgccgccccgtctgggatgtgaggagcgtctctgcccggcagccccgtctgagaagtgaggagaccctctgcctggcaaccgcccagtctgagaagtgaggagcccctctgcccggcagccgccccgtctgagaagtgaggagcccctctgcccagcagccaccctgtctgggaagtgaggagcgtctccgcccggcagccacccagtccgggagggagatgggggtcagccccagccaggccagccgccccgtccgggagggtggtgggggggtcagccccctgccaggccagctgccctgtccgggaggtgaggggcgcctcagcccggccgcccctactgggaagtgaggagcccctctgcccagccagccgccctgtccgggagggaggtgggggggtcagccccccgcccggccagccgccccgtccggaaggtgaggggcgcctctgcccggctgcccctactgggaagtgaggagcccctttgcctggccgccgccccgtctgggaggtgtacccaacagctcattgagagcgggccatgatgacaatggcggttttgtggaatggaagggcaggaaaggtgggggaaagattgagaaatcagatggttgccatgtctgtgtagaaagaggtagacatgggagacttttcattttgttctgtactgagaaaaattcttctgccttgggatcctgttgatctatgaccttacccccaaccctgtgctctctgaaacaagtgctgtgtccactcagggttgaatggattgagggcggtgcaagatgtgctttgttgaacagatgcttgaaggcagcatgctcgttgagagtcatcgccactccctaatctcaagtacccagggacacagacactgcggaaggccgcaaggtcctctgcctaggaaaaccagagacctttgttcacttgtttatctgctgaccttccctccactgttgtcctgtgaccctgccaagtccccctctgcgagaaacacccaagaatgatcaataaaaaagaaaaaaaaaaaaagaaaagaaaactgttaagatcattcctattccaacattcttattctatcttaaattcttgtctttttctttgtgaaagggttatgggttgaattatgtcctcagaaggatatattgaagtcttaagccccagtacctgtgttactggtggaaggtgtccaggttcttggcattttgaacaaagaattggacaaaatgcacaggtttgtcaaaggtcagatggctgtaggtgtgcagttttatttctgggttctctattctgttctgttaccagtggagggtgtccaggttcttggcattttgaacaaagaattggacaaaacgcacaaagcaaggaaagaatgaagcaaggaaagcagagatttattgaaaacgaaattacacaccacagggttggagtgggctgaagcagccgctcaagggccccgacacagaatcttcttcggtccaacactccctagaggtttcccattggccacttggtgttccccttatgtaaatgaagtggtggcccacagtcagaggctaaagtgaagttacaaattgcacttctatgcaaacaaagacttggcccgcaatcagaggctgaagttacaaagttacaatcctatgcaaaaagcaaccaatcagaggtattttcaatttcccatctgccccacagaaagggtggggatttgcaaagggagtagcctctggtccttttgttacttaggcgtggaaagttagggttttcctttccatttccttctaggaagtcagtgtgaatcagcctcaggttccctacctccagaccctattctcctacctcacctgtaaatgagaacttatttggaaataatcaaagatgtaatcaaattaagataggtcattagggtgggccctaatccaatatggctggtgtctttctaagagtagaagatgcacagagacacggggaagaagacagccatgtgatgacagaggcaacaattggagcgatccatctacaagccaaggaacacccatgattaccagaaaacaacagaagctagaaggagacaaggaaggattctcccctccaggtttcagaggggcaggctctgaaaacaccttgatttcagaattctagtgtccagaactgtgagaaaataaatttctgttattttaagccacccagtttgtactactttgttacagtagccctaggaaactaatccagaaagtgtccccaaaacatgtctatcttgtgctatcaaactgttgtttccaagagtcctaccttctttcatatctccatttctaattaaagaaagtttaaacacagcattctaaattcctgatttagcaatttcattaaatgataaaaattaatgcatgatataccagatattcggaaaacataaattgccagaagattgttatagcaacatccatactaattaacatgtcttaagaaaggccatgcgtgtttatcatctaattagaatcatacaatcaaaagaataaagagtacttccttgggggatataaaataaataaataactacaatattttcattaaagttggcaatgttcctttgaacctatttgaatgctagaaattgatgtataaattaaatggttttatagtttagatttgatatttagaagagatttagaccattagtgcaaattattttaaaatgtattttgtgtttgaaaaatactatgatgcttacaatgctatgtgaagaaaatgagctacaactcatttaaaatcgtgaataaaagggtgttttagagactgatgtccgtattcctatgagacctgaaaaattttccaaagttcagagtgtttgacaaaaaaatgcaccaattcctagatatggggtttgccaaattgtaacccacaggccaaatccatcccatcactggttttttgtacagcctacacgctaactacacacacacacacacacacacacacacacacacatatatatatatacacacacatatattaaacagttaaaaaaattgaaagaagaaaaatgttttgtgactcgtgaaatttacatgaaattcaaatttcagtgttaataaataaagttttatgggaacacatcctccctcactcattcatttacatattgtctatggctgtttgcatcactttcctgttgctgtataacaaattaccacaactttagtggcttacttaaaacacaaatttattatcttacagtttccactggtcagcagtcccggcaggactgggctgtttgttcagggtctcaccaggctgaaatcaaggtgttggccagggtggtagtctcatctgaggctcaaggtcctctttcaagctcacctagttggcagaatttaattctttgcagttgtagaactgggactcccattcttatgctggccaccagccaagggctaccttcagctcctagaggctggttacattccttgccacatggcccctccatcttcaaagtaagcaatagagagtctccctcacattcaacctctttaacattttgaatctctcttactaggaagagccctatcccttttaaaggctcacctgattaggcaaaacctaccatgcataatctccctattttaaggtcaactgatttgagacattaagtatgtctccaaaatcccttcacggcagcacctagattagtgtttgattaaataactgagataaagtttgtatgcatcaggggccaggaatctcagaagccatcttagaattctgcctaccacactgttgccatgctatgatgggaaacttcagtagttgcaacagagaccacatggccagcaaagcttaatatttggcccagagaccatacggccccaaattacttactatttggcccaaacagaacaagtttgctgatccctgtcccaaattaagctgagtttcaaacttgaaaactgcatgatctccgttcagcaaataaccctaaatctgggacagtgtaaacagaagggagaggccatgagagtgagacaatagtagcattaccaaactgtttcaacttttcaactcacatacacacacacacacacacacacacacacaaatacagatggtactgaactggtggtacttttttcttttcttttcttttcttttttttttggagatggaatcttgctctgtcacccaggctggagtgcagtggtgcaatctcagctcggctcactgcaacatccaccccctgggttcaagtgattttcctgcctcagcctcccgagtagctgggactacaggcgtgcaccaccacgcccagctaatttttgtatttttagtagagatggggtttc[131 bp omitted]cacacactaggggactaataaaatgataactcgcgtcataatattatcactgcccatctttgtcaaatcttaacatgtttgcttcttttaaaagtaataaaaattggccaggctcggtggctcatgcctgtaatcccagcactctgggagaccaaggtgggcagattacatgagtccaggagtttgagaccagcctggccaacatggtgaaatcctgtctctactaaaaatacaaaaaaattaactgggtgtggtggtgcatgcctgtaattccagctactcgggaggctgaggtgggagaatcacctaagcttaggaggtcgtggctgcagtgagcggagatggcaccactgcactccagcctgggtgacagagtgagactttgtctcaaataaaaaaaaaagtaataaaagccataacaatgtagcctcctctgatctcatgccactccctccaccttcagaggtaaacactatcccttccacctattcatctatccacagaaaacatattgcaatttgtcatcttttgaactttacagaaatcaaactatatagcacgtattctgcaatttccttctcttgcttagtgtgtttatgaaatttattcccatcaatgtgtatagctaaaatttgctcatttttactgacatacagcatcccattgtataagtataccatggtttatttttctattcaactggtggtgtacatttgggttacatgtagtcatttactattacaaacaatgctgctatgaacattcttgtgtggtctcctgactcagatatgaaaaagtatccctggctgggcgtggtggctcacacttgtaatcccaacactttgggaggccgaggcaggcagatcacctgaggtcaggagttccagaccagcctgaccaacatggtgaaacctgtctctactaaaaatacaaaaaattagccaggcatggtggtgcatgcctgtaatcccagctacttgggaggctgaggcaggagaatcacttgaatccaggaggctgaggttgcagtgagccgagatcgtgccactgcactccagtgtgggcgacagagagagactccgtctcagggaaaaaaaaaaaaaaaaagaaaaaacaaagaaagaaagaaaagaaaaagaaaaagtatctctagcatattatctgagagtagaatttctgggtcttagggtatgtgtatgtttatctttattagatattatcaaattcttggccgggtgcagtggctcacgcctgtaaacccaacactttgggaggctgaggcaggcagatcaagaggtcaggagatcgagaccatcctggccaacatggtgaaatcctgtctctactaaaaatacaaaaagaaattagccaggtgtggtggcacgtgcctgtagtcccagctactcaggaggctgaggcagaagaatcgcttgaacccaggaggcagaggctgcagtgagccgagatcacgccactgcactccagcctgtgcgacagagtgagactctgtcccaaaaaaaaaaaaaaaaaagaattgttctccaaaatctttgtgctaatttatactccaactaacagtaaacagttcccttttccctatgcccttaccaataattaataccatcaaacttttaatttttaccagtctcttgggtatgatgtggtggtttcattattgtttaattttgtattttcctgattacaaattatataaaatagctttccgtatttttactgtatcttcagatttcttcttctgtgatctgcctattcataagcccttgacaattttcctattgggccatttattggtttttaactaatctgtagtctttacatattctaatactaaccctttatcacttatattcatttattcattcattcaacaagtatttatttagtatatagtatatgccacacattatttgaggacagaaggatgtggcaagtcagcaaggcaaagtccctgatctcaaggagtttgaattctagtggggagacatgcaataaagagcaaatagatatataatatcaggtagtaataagtgctatgaagataaaacaaatggagaagatgaagtgacgatggttttattttcaatacggtggtcaaagaaggcctctttgaggaggtgacatttggacagacacattcattaattgaagaagagagtcagatgtatatttgaatgaagagtattcttccaggcagagaaaaatcaattgccaagggtctgggataaaagcaagcatgttgcaattatcttttcctagactgaagcttgttttttcattttgtttatgacttgtctttttgtacgcaagttttaaatttttaatgtagtataatttagccagattttactttatttatggcttatctagctgtattttgtttatgaaatccctccttactacaaggtcataaagatatttgccctgaccaggcgcggtggctcatgcctgtaatcctaacactttgggaggccaaggcgggtggatcacctgaggtcaggagttcgagaccagcctggccaacatggcgaaaccccgtctctaccaaaaatacaaaaattagccaggcgtggtggcaggcgcctagaatcccagctacctgggaggctaaggcaggagaatcgcttgaacacagggggcagaggttgcagtgagccaagatcatgccacttcactccagcctgggtgaaagagccaaactctgtctaaaaaaaaaaaaaagatattttcccatgctgtcttctaaaagtttgtaactacttatcacatttaggtcataaaaccactttgggccgggtgcggtggctcatgcctgtaatcccagcactttgggaggctgaggcaggtggatcatgaggtcaggagatcgagaccatcctgactaacacagtgaaaccccatctctactaaaaatacaaaaaattagccgggtatggtggcacgtgcctgtagtcccagctagtcaggaagctgaggcaggagaatcgctcaaacccaggaggcagaggttgcagtgagccgagatcacgccactgcactccagcctgggggacagagtgagactccatctcaaaaaaataataaaataaaataaaaccactttgagtttgtttttgtgtacaatgtggggttgagattttatttttttcaaaataataaccagtggttccaacaacatttattaaataaatcatttccacactgatcatgtattaagattttctttacacgtggtttctgggctctttgcattctgtcccactggtctatttttctctgtactgccttaattactacagcttataagaagtgctgccatcgggtagggtatattgtactgctttaatattgtcttgcttattcttggttctatttagaattttaattggaattgcattcaatctctaaatgaatttagggagactttgcatcattacattattaagtcttcctatacatgaacatattttatctattaacttagattttctttaatgttattcaataaagatttatacttttttgcatataggtcttgtacatcttttgttagatttattcctgggtgtctttcagtttttgtttctactgtaagctctaattggtacactattgtttttttatattgctcttatatcctaaaaccttgcttcaatattttacatatacttttgtattttctatgtggacagtcatgtcatctgcaaataataagctttgtttctccttttttgatccttactttttatttattttccttttcttactacactaattgggacctacagtacaaggttgaatagaagtgctagttttgctcctttgtatcattatggtgacgtaaattaatagttttcttaagttagatcactcttttattactgagataaacccaccttggtcataggtattttcaatgcatttttcattctgattgctagtattttgttttagattttggcatgtatgttcacaagtgaagttagcatgtaatttttctttctcataatatctttgcctggtttagcatagaggttatgctagccttataaaacgagttgggggagatttaatccaacagtttatatagtattgagattatctgttccttgtatatctgatagaattcacctatacaaccaactatctagcaggtaggtggtggttgtttgttggttgatagattttaaccactgcttcaatttagttcacaaacataagtctgttcagttttccccattttttcttgagtcaattttggtaaattttagctttatataaaattatccatttaagtgttcaaatttaatggcataaagatgttcataaagttatttttatttcaatgtcctatctactgttacttactttacacccatttatggtttggtttttttttttgttagatggagtctcactctgttacccaagctggagggcagtggcgcgatctcagctcactgcaacctccacctcccggtgcaagcgattctcctgcctcaggcttctgaggagctgggactacaggcatgcgccaccatgctcagctaatttttgtatttttagtagagatagggttcgctatgtcggccaggctggtctcgaacttctgacctcaggtgattcactcgccttagcctcccaaagtgctgggattacaggcatgagccactgcgcccggccccattttctttttttattcattgatggcactgaatttattgatgagtaggtgatttttttatggcttatctcatgatttattcagatctttaatgtctttcaatgaagctttacaagtttgttcttaaatgctttattttttgttgctcttgaaaatggcctttttaaaaaaaataatgtatttttgtgtatagtaaccctatttattctatttttaaaatcttttattttaagttcaggggtacatgtgtaggcttgttacataggtaaatgtgtgtcatgagggtttgctgtacagattatttcaccaccaggtattaagcctagtacccattagttacttttcctgatgctctccctcctcccaccctccaccctctgaaaggccccagtgtgtgaaagacccctctatgtgtccatgtgttctcatcatttagctcccacttataggtgaggacatgcagtatttggttttctgttcctgcattagtttgctaaggataatggcctccagctccatccatgtccctgcaaaggacatgctcttgttattttttatagctgcatagtattccatggtgtatatgtaccacattttctttatccagtctatcattgatgggcatttaggttgattccatgtctttgctattgtgaatagtgctgcaatgaacatacatgtgcatgtgtctttataacagactgatttatattcctttgggtatatacccagtaatgagattgctgggttgaatggtagttctacttttagctctttcaggaatcaccatactgctttctgcaatgggtgaactaatttacactcccaccaatagtgtacaagtgttcccttttctctgcaaccttgccagtgtctgcttttttttttttcctttttatcatagccatacagactggcttgagatggtacctcattgtggttttggtttgcatttctctaatgatcagtgatattgagcttttcttcatatgcttgttgttcatacgtatgtcttcttttgaaaaatgtctgttcatgtcctttacccactttttaatagggtcgtttagttttttcttgtaaatttgtttaagttccttatagatgctggatattagacctttgtcagatgcatagtttgcaaaaatgttctcccgttctgtaggttgtctgtttactctgttgatagtttcttttgctgtgcagaagttctttcatttaattagctctcctttgtcaatttttgcttgtgttgcaattgcttttggtgtctttgtcatgaaatctttccctgtgcctatgtcctgagtggtattgcctaggttgtcttccagggattttatagttttgggttttacatttaagtctttggttcatcttgagttaatttttgtatgatatggtataaggaagcggtttagtttcaatcttctgcatattgctagccagttattccagcagtatttattgaatagggaattctttcctcattgcttgtttttgtcaggtttgtcaaagatcagatggctgtaggtatgcagttttatttctgggttctctattctgttctgtcacgggtggagggtgtccaggttcttggcattttgaacaaagaattggacaaaacacacaaataaagcaaggaaagaatgaagcaaggaaagcagagattcattgaaaacgaaagtacactccacagtgtgggagtgggcggagcagtggctcaagggccctggatacagaatcttcttggggggagggagagcatcaggataaatagctaatgcatggggggcttaatatctagctaatgggttgatctgtgcagcaaaccactatggcacacatttacctatgtaacaaacctgtccgtcctgcacgtgtataccggaacttaaaataattttttttttgagatggagtcttgctctgttgcccaggctggagtgcagtggtatgatatcggctcactgcaacctccgcctcccaggttcaagcgattcttctgcctcagcctcccaagtagctgggactacagacacacgccaccacgcccagctaatttttgtatttttagtagagatggggtttcaccatattggtcaggctggtctcaaactcctgacctcaggtgatccacccgccttggcctcccaaagtgctggggttacaggcgtgagccaccgcacctggccataaatttttttttaatggaatgttcggacagagaccgagacatggggagaaagccacgtgaagaaagatgaaggcagagattgaagcaatgcatctacaagccaaggaatgccaaagattggctgcaaacccccagaagcaatgaaagaggcatagaaaagattctctctctcagccttcataagaaaccaaccttgctgaccccttgatttcagacttctgttccctagatctgtgagacaatacatttctgtgctcagtttgtgccactatgttataacagccttaggtaatgaatgcagcattagttaatgaagcattgacattgtccagcataatactggactagatgtccttaagggcacttctttacttctctaatacacaatttttaaaatggttcaattcaatgacagaagacaataaattgttggaaatatatttaattcatttattcattcaacaaatattcattgaacacactacatggcacagtagggaacaaaacagacaatcccctaccctggtggagcttacatgctaatgaaggagacagacattaacaaaaaaaagataaatacatagccacaaacttgttaagtgatattaagaaaatacagggtgtggccgggtgcagtggcttacacctgtaatcccagcagtttgggaggccgaagcgggcggatcacctgagatcaggagtttaagaccaggctagccaacatggtaaaatcttgtctctactaaaaacacaaaaattagccgggcgtggtggtgcacacctgtggtcccagctactctggaggctgaggcaggagaatcacttgaacctgggaggtggaggttgcagtgcaccgagaaagtgccattgcactccagcctaggtgacaagagtgaaactccatctcaaaaaaaaagaatgaaagaaagaaagaaagaaaagaaaagaaaagaaaagaaaagacagggtgctaggagagagtataagagagtattcatagacgtcctctctggagagacaatatttaaactggaaagttgaaggaagagaaggatctctatgtgaagacagggaagctcatttcaggcagaagaaactgcatgtgcaagggtcttgatgtagaaatatgttggcatgggtaaagaacagaagggctattagaacttgatatgcttgggaaataagagagagaaaaaaagtcaaagatgactaactgggaaactgagtgaatagtgggagctattgactgaggtgtggaagaatctaggaagaatgaaatgggtcagggtaggaagcaaaagttcagttttagacatgttaagttgggaatcagtaaatcttcaagtgggaaacaatatataagcttagagctcaggagaaaggcgtgggctggagatagaaatttgggagtcatcagtataggtggtatttatagccctggaactggaaaggattattagcaagggagtaagtggggctagagaagggagaagggccaaggactgagtcctggggcatcctgactcagagatttggcattgtcagatctgcattgtcatctgagactctcccttcccaactatactgcctttcccctttctatccgcaagtgtcaagtctgtgtcatggtctgaggcatttcctgcccaatcttgcttcctccccttttgtaattcacaagcagaccccaataaacttcttacactgctaattctgtctcagtatctgcttcccagaggacctgaactgacacaattggtaccaggattggtctgagaaagcaggagatgattggggttttggcactggatcacttaatgaaatgaaatgaggacttcttcccaagtagtatgtggaccatggatagtccctggtacaagatggtggcccaactgctaaaactgtcactggtagtaacttgggagagtgttctggtaaaaagaaaatgctctggcaggtgcaatgaagagtagagatgaataactttgcatagaaggactgtggacttggctggctgtcattaaggtgcacagacaccatatgaagggacaattaagtggctgagggcagttaactattgaaaactaagcatgaaggccagaggacctctttggtagctcataaagatgttcttatctcgttcagtgagacagcagaaaaacctagagatcaaactcagaatgaccaagcttcaaaggtgactgtatactcatccaagccaggtccacgatactcaagtcagcactccagttaggcaaacccaggatcgtggcaaacagcatgggaatgtctaagtgggtgctcccaaagattttgactcctcagactgctctgaacctttagagcctgcagcagtaactcatctctccctattaagggctggcatccaccccatcctttgtgggaagacagcacaaaggcctttcccttataaggcaccaagatctgcctccaccttttctcctggctataagaccagtaagtagggttaagtcagggtgtaagcctgccagggatgcgctgggcctggtaagaaaggaaaagatctataccccaaaggagttgtaagatctagccaacatatactaggagtcagagaggtcccacggactggatttagagtgtttgagcaatggggccagaacataagactaggtaagggagagtttattgatttgggggcactgtccaggaatacaggacttagcactgtggcaaggaccctaggagttggtgtaaactggcagtcagggtggcccctagaaccctggggaaagtgataactcacattgagtgagggtgaaatgcctaaattgccaggacagatggtaatgaaaggaactaagtagcgcaggaaggtgaatatgctggagtggttatataacctgaggcccgaagaccagccagagaattatgttgcacaggagggctcaggagatgcacgatttaccaacgccatgtggaatgccctggtgaaaggggtgccagcatcaccaagatgttccatggtgttgctcctctgcaggccaaggtggactacaggagaggcaatcacagagctgggcttgttaatggaagccaaagttataagggccgagtgactgtgtttaactgcccgaagtcagaaggctgcacttagaccacagtgattagcaatcagaggagcagccaaagacactccaggagttaagaggattaatagtgcatgttgtccctagaggcaaaataggtggattgccaacaagaatatcgtttaattacataatttttaagtggcaatagatgaggaggaggttgaaggtcaacactcctataaaaagccatgatctcctgcctagttcctggatctgagttatcagacttaggactcattgactgaagaggtggctaggtcccctggaagaagaaccctacacatcaccatggcaattataaaccatagtttgagtccttctcccaaaaggacctaagacttagatgactctacacgaaggacagacatttagagactactggaaattgatgtctagagacccaaaaagtttctctaacaaggaattccaggtaataagcaaggagacagaacacaaatttggatagaagatagtttaccaatataggagtactctcctggtatacacccggggaagggccctggaagacagcacaaacacaatgctaggatagatcctagaagcatgaaaaacatgttgtctgacactaagtgcagtagaaatgcctacattgccctggcagatagtgaagaaaggaatgagaaggctcagggaggtggacacgctggagtgcgtatgtcatgtgaggccagaagacccactggaggattctcttgtacagaaggactcagggaacatccagttcacccagtccataaggaatgtgctggagagagggatgccagcatatcaccagtaaattcaatgtggctctcctctgcaggccagagtggatgataggaggggcaatcacagagctgggctcataactagcaatggggatgacggggcctcttccatcctggaagggccagcaattcattctcacaggatggacattctttctgaatatggttttgcctttcctgcccacagaacctcatccagcaccaccatccaggggcttaaggagtgcctgatccacaccatggaatccaacacagcacagcatccaaacagggaatttatttcatagcaaaggaagtttgggagcgtgcctatgaccataggatcccctaggcatgcaacattccacaccattcataagtagctggcctgacagagtgatggaatggcaaggagcagctgaagcaccagctcagaagcaacactctgcaaagatgtggtagcatcctccaggatgcagtgtaagcactaaattagagacctctatatggcaccatctcgccaagaggaaaaatacatgggtgcaggaaccaaggagtgaaagcaggagaaccatcattctcaataacctactagtagcaagacattgtgctttcagtctccacaacctggggctctacagtgtaagaggtgagcacactcttgccaggggcgtagcaggagtcccattgaactatacgctacagctgccaccagagcattttggaggtcagagacatggggagtaaaaattagaaatactctgttataagatgcctgcactactcatgaagcagtatagtgttagttgaaggttgacttacattagttaaaaatgtacgttataggctgggcgtggtggctcatgtctgtaatcctgacactttgggaagctgaggcaggaggatagcttgagctcaggggtttgagaccagcctgggcaacatggtgaaaacttgtctctacaaaaaaatacaaaaattagccaggcagcatggcacgcatctgtagtcccggctacttgcagggctgaggtaggaggatcacttgagtccagaaggtcgaggctgcagtgagccgagattgagccactgcactccagcctgggtggcaaagtgagacccggtctcaaaaataaattaattaattaaaatgtatattataaagtatagggcaaccattgcaactgatacattaggagaggagataaaatggaatcatatgaaaagctcaatttaaaccagggaaggcagaaaaagacaatagggaaaaaacaaagaacaagagcaataaatagaaaacagttataaaaatggacacaaatacacacttagaagaaataagacctggttttcaatcatcagtagagtgattaa[145 bp omitted]gaaaccccatctctactaaaaatacaaaaattagctgggcgtggtggcatgcgcctgtagtcccagctactcgggaggctgagacaggagaattgcttgaacccaggaggcagaggttgcagtgagctgagatcgtgccactgcactccagcttggatgacagagcaagactctgtctcaaaaaagcaaaacaaaacaaaacaaaatagctagaggagaataattcaaatgttcctagttaaaagaaaagatttatgtttaagatgatggatattctaattaccctgatccgattatgtaaatgcatcaaattatcacatgtatcccaaaagtatgtacatctaatatgtatcaatttaaataaataaatatacgaaagaaaatagttataaagatggtagatattagtctgactatatcaaagtcactttaaatgtgaatggtctaaatgcaccaattaaaagacagagattgtcatagtggataagaaaataagctccaattacacactgtttataagaaatccacttttaatataaagacatagacatattaaaagtcaaaggtatggtggctcacacctgtaatcccagcactttgagagcctgaggcgggaggattgcttgagcccaggagtttgagaccagcctgggcaacatagtgagaccccatctctacaaaaaacttaaaaataaagtaaaaagatagccacagatatactaaaaaaacaaaaaacaaacaaacaaaaaaacaaaaaaacactgaacacaagaaagttggggtagttatatttctatcagataaagcaggtttcataacaaggaatgtcatcaagaataaaatggggatcattctgcgaccggcactccacaggtcagatggctgcaaagcagtggcggaggtgaccatagccacataatgtccatagttcgtttatccgtccatgccaaatggattatggggaaggtgactgggacaaaaatgcaaaagactgctaaagtgagagtgatcaggcttgttctggatccccatttattaaagtattataataagcaaaaaacgtactttgctcacaatgcccttcagcagtgcacaattggggatatcgtgcttctcaaagctttacctgttccacgaacaaagcatgtgaaacatgaactggctgagattgttttcaaagttggaaaactcgtagatcctgtgacaggaaaaccttgtgcaggaactacctatctggagagtccattgagttcggaaaccacccaggtaagcaaaaatctgaaagaactcaatatctcttcagcacagtgaaggaagaatggaagaagaagccaaagggaaagatttacatgtttgtttattttatggaaaaagaaatttttctaagtttcatcacaaactgtgtccaatttctcttgtggtatttatgaaatagctaaaagcaaatgaagtaaagggcatattatggtttttcacaaaggtttatggtcatgcttcaaattttcttttcagtgaacatactttcacgttacactaagtgtgtctagcggtctgttgcgttttgtaagctcactgttttagaaggttttgttttcgttttttgagacagggtctcgctttgtcgcccaggctggagtgcagtggtacaatcttggctcactgcagcctcgacttccctggctccagcaatctttccaccccagccttctgagtagctgggagcacaggagcgtgccactacacctggctaattttttgtaaattttgtagagacagggtctccctatgttgcccaggctgttcttgaactcttgggagtgaaatgctcacattggcctcccaaagtgctgggattacaggcctgacccattgtgcccagccagttttctttttttcattcaaaagaatcttgaatttaccttagaacctttattttgagggaagaaagcctttgaatataaacaaataaggccacattaagtgaatcttttggatgctatatattcaaaataaatattttatttttctgacttcaccagttccaaagggaaataatcaacatgcttatggtcagaattttttttgatcaagctgtattattaagaatgttgacatatagaaaataaaattttacaattctgaaaaagaaataaaataaaatggggcattatgggggtcaagtctcaagaaaacaatacaatcttaaaacgtgtatgccctaacaacaaagcatcaaaataaatgagacaaaaattgatagaactgtaagaataactagacacatctactattatcattggagatttcaacacccctctgtcagcaatggatagattaagcaggcagaaaatcagtacaaatatagaatggattgtggagaaggaagaaaatgaaacctagtggcagccctgagaccaactgcagcaagatgagctattgctcttcccactaacctcctcttctaagtcttccctcaggaagagaggttcacaggaactctgaacaagaactctgaagttaatccaagcaacacaaaggatggactgtggcaagcatggagctgcatagctcagagctcccatcaagaaagactttgccatggaactatgaggagtgaagttagcttacagcctcaggttgcaggaccttccaagactggctgcagtattcttgacaaaaccatgctttccctgggcagcctccagtcaataactaagcaaggtggcagttctagggcctggccacttctgcccaatgtgagactcttttaagaggcagtctttcctccagaactccccactgggttgagaccaagactttgtcatatttgcctcaaagtctaaggcaactctgccaaattctgtttccaccccttatcctttcacatgtgtcagatatgcattgtagtttgaatgcctttcctgcccaatcttgctctctgcccttttatctttcacaggtattagccacaatcaacatcctgcattcctaactccgtattagcatctgcttcctagaggacccaaatagacacaattagccacacaccactgccatccactttggggaaattcttcagaatacacttaatcaagcatttcaagagtctcttcattatgatcaaaatgttttcagcaagttcttcagtttaattcataactaggaaaatcagataatgaaaaccatttaataccacag[174 bp omitted]gtggcacgcgcctgtagtcccagctactcggaaggctgaggcaggagaatggcatgaacccgggaggcagaggttgcagtgagccgagatcgtgccactgcactccagcctgggggacagagtgtgacactcagtctcaaaaaaaaaaaaaaaaaggcatgtgtgctgtagctacagtttttacaatcactgcattcggtttatctggaaggatagaacactgatgaagcttgtcatacaagcatacatttgggctgcgtaaagttaatcttaatcatgcttatgatcattcagattaagggtttttgttccagaaagatacaagatttttcttgaaactcagtcaagtgatgaattttccttagggaagtcagtgacttccttgagcaaaagtagttatttatggtcattaccctaacctcataacaaagctggaaaaaaaaaactttaacataactggcaagcattaagtgcttctcataaccttcatgtgtagctcaggtagagagggctttcttgtggtcaacagtgtgtagctgtgttagttagtgctattgtttggatgtttgttcccccaaaactcatgtggaaatttgatccccagtgttggagatggggcctattaggagatgtttgggtaatggggcaaatctctcatgaatagattaatgccctagggagggaagtggtgagtgagttctcactctattacttctcatgagagctggttgttaaaaagagcctagtacctcccccttctctcccttgcttcctctcttgccatgtgatctctgcatacactggctcccctttgccttctaccatgagtggaagcaccctgaggcttttaccaagatgcccaacattccagcccgtggaaccatgagccaaacaaacctcttttctttattagctcagatatttctttttctttctttctttttttttttttttagacagcgtctcactctgtgacccaggctggagtgcagtggcacaatctcaactcactgcaaccactgcctcccagactcaagcaattcttgtgcctcagtctcccgagtagctgaaactacaggtgtgcactaccacatccagccaattttttgtatttttagtagagatggggttttgccacattggccaggctggtctttttgtttgtttgtttttgtttttgtttttgtttttgagacagagtctggctctgtcacccaggctggagtgcagtggcacgatcttggctcactgcaacctctgcctcctgggctcaggcgattctcgtgcctcagactcccaagtagctgggactacaggcacacaccaccataccttgctaattttttgtatttttagtagagatgaagtttcactatgctggccaggctggtctcgaactcctggcctcaagtgatctgcctgccttggcctcccaaagttctgggattacagacatgagccactgcgcccagccagatatttctgcataccgacacaaacagactgagacagtcaggtagactagaatctgctgtggtaacgaagaaaccctgaaatttcagtggcttaaccaaaggttgatttttcactcacacaaagtcctatgagatggttcctgtatgagcaactctccagggtggttttcctctgaggggtaaacccaaggatacaggttccttgcatcgtgttccaccatttcagagtcctttgcttcctgctgtacaagagcaaagagatttattaatagcatgaaaaatcatgaagggtattacatggtttaggcctagaagtggcagttatcaatcctacacatgttcccttgccaaaacaaaaccacatggtcccatttaggcaaaaagaaagcttggaaatgtaagggagcatgtggatattggtggatagtctctggcataatagactttgcttttgatataacagcttgaaaacatgaaacaagctctaacgttggatttacctaagctttcacactctttatagtttatcctgacacatcaccttcagtctaagttattcacataaagtcatcaataagcttaaatttcttctctatctcaattaattacatcaccatccacccatttgctcaagtgcaaaacttaaaatttatctgtgtttctgctacatagaaactggataaaagagccgggcatggtggctcacgcctgtaatcccactactttgggaggccgaggcggacagatcacctgaggtcaggagttcgagactagtctggccaacatggtaaaaccctgtctctatgaaaaatacaaaaattagctgggcatggtggcgggtccctgtaatcccagctactcgggaggctgagacaggagaatcgcttgaacccaggaggcagaggttgcagtgagccaagatcccaccagtacactccagcctgggcaacaagagcaaaactccatctcaagaaaaaaagaaactggataaaagaaagccaaagagccctgtgcaggagtgatcccagagcagcttctatgaatattacaattccacttggaaggaattcctaaagtgaagatggattggcagaattacctgtgaagttatgctcacaatgtcaggttcatttaaaaaaagaaaataaaatagaacgacctatgaagagtattttaatatttccctttgctctaaggctgtgttttatactaacttcttattgcagtgtgatagcccattaagacttccctaaagggaagagggttccctgaatatcctatgtgagtattcaggtctgcttaacagttatagttctcactgtcaattaataaactgacattttggttcatatatatctgtaacttatgagtagaatcattcattcattcatatatttaacaaatatttattgagtgcctagtaggctacagttttaaatgccaaaaatatagaagtataccaaacagataaaacctctgccctcacagagcttacatcttagtaggctaaagagagacagattttggcccagagtggtggctcacacctgtaatcccagcactttgggaggctgaggtgggcggatcacttgaggttaggagtttgagaccagtctggccaacatggtgaaaccccatctctactaaaaatacaaaaaattagccacatgtggtggtgcatgcctgtaatcccagctactcaggaagctgaggcaggagaattgcttgaacccaggaggcagaggttgcagtgagccaagatcgagccactgcactccagcctgggcaacagagcaggactctgtcaaaaaaaaaaaaaaaaagagagagagagagaggtttttttaagaaaaatatatagtgtgtcagatggatagtggtaaattctatagaaaacaagaaagcagggaagggggacagaatgtaccaaggtgggggttacaattttaaacagagtattcaggcctcactgggaagaagacatttgagcaaatctctgaaggaggtgaagaagcaaccattcagatggctatggaaaagcattccaggcagaagagacaccaagcgcagaggcctgaggtggggagtgcctggtttgtttatggatcagcagaaaggccagtgtgactgaagtagagtgaacacaggagagagtagtggcgaggagtcagagagataatgtgggggcagtggggggatgagggaaagattgtgtagggccttgcagagcagtattaggattttggatttttgagatgtagagtcattggagggttccaaacagt[133 bp omitted]atggtgaaaccctgtctctactaatacaaaaattagtcaggtgtggtgctgtgcacctgcagtcccagctactagggaggctgaggcacaagaattgcttgagcccgggagcagagtttgcagtgagccaggatcacaacactgcactccagcctgggtgacagagtaagactatgtctcaaaaaaaaaaaaaaaagtttccatttgccacgatggggaaggcaagggagggacagatttggtggggtagatcaggggtctcacttgagacactttatgattgagatgcatatgaaatatctaagtggagctactaaaggggcctctgaacatggtgtgtccggaattggtgggttcttgggtctcactgacttcaagattgaagccgcggaccctcgcggtgagtgctacagctcttaaggtggcgcgtctggagtttgttccttctgatgttcggatgtgttcagagtttcttcattctggtgggttcgtggtcttgctggctcagaagtgaagctgcagaccttcgcggtgagtgttacagctcttaaagaagcacgtctggagttgttcgttcctccggtgggcttgtggtctcgctggcttcaggagtgaagctgtagatcttcccagtgagtcttacagctcataaaagcagtgtggaccaaaagagtgagcagtagcaatagcaagatttactgcaaagaggaaaagaacaaagcttccacactatggaaagggacccacgtggcttgccactgctggctccagcagcctgcttttattcttttatctggccccacccacatcctgctgattggtagagccgagtggcctgttttgacagggcactgattggtgcattcacaatccctgagctagatacaaaggttctccacgtccccatcagattagttagacacagagtttcgacacacaggttctccaaggccccaccagagcagctagatacagagtgtcaattggtgcattcacaaaccttgagctaaacacagggtgctgattggtgtgtttacaaaccttgagctagatacagagtgctgattggtgtatttacaatccctgagctagacataaaggttctccaaggccccaccagagcagctagatacagagtgtccattggtgcactcataaaccttgagctaaacacagggtgctgattggtgtgtttacaaaccttgagctagatatagagtgccgattggtgtatttacaatccctgagctagacataaaggttttccaaggccccaccagagtagctagatacagagtgtccattggtgcattcacaaaccctgagctagacacagggtgctgattggagtgtttacaaaccttgagctagatacagagtgccgattggtgtatttacaatccctgagctagacataaagactctccacgtccccaccagactcaggagcccagctgggttcacctagtggatcccgcactgggcctgcaggtggagctgcctgccagtcccgcgccgtgcgctcgcattcctcggtccttgggtgatcgatgggactgggcgccatggagcagggggtggtgctcgtcggggaggctcaggcggcacaggagcccatggagtgggtgggaggctcaggcatggcgggttgcaggtcccgagccctgccccgcaggaaggcagctaaggctcggtgagaaatcgagcacagtgccagtgggctggcactgctgggggacccagtacaccctccgcagccactggcccgggtgctaagtctctcattgcccgggaccagcagggctggccggctgctcccagtgcggggccagccaagcccacgcccacctggaactccagctggcccgcaagtgccgcaggcagccccggttcccgctcgcgcctctccctccacacctctctgcaagctgagggagtgggctccagccttggccagcccagaaaggggctcccacagtgcagtggtgggctgaagggctcctcaagtgccgccaaagtgggagcccaggcagaggaggtgccgagagcaagcgagggctctgaggactgccagcaggctgtcacctctcaatgggagtccagagttcaggggagaagtccaaactagagatacagtagtcctctcttatctgtaggagatctgtcccaagatccctggtggacgccttaaaacatggatagtattgaacccaatatatatactgtttttttttcacctgataaccgagagagctactaagagaccaacaggcaggtatcatggacaacttgggtacaatggacagagggatgattcacatcccaggtaggacaaagcaagatttcatcacactactcagaatggtgcataatttaaaacttatgaattgtttatgtctggaatattccatttaatatttgcaaactgtagttgaccacaggtaactgaaactgaggaacatgaaacttcagatgagggaatactacagtatatatttgggagtcatcgggacatagatgacatttaaacccatgagactaaatgagatcagcatggaaatcggtttaaatggagaaaaagctcaaggagttagcctagagcactcgaatattttagaggtcatggagatgaggaagaaccaacaaaggagaccaagaaggagtggcggtagttatcaagagtcagccttctgagcctgctggctgcagggtatcctgataaagctgaatttctggatctgcagagctaagaaatcaacagcagggaccctcaccaaggtactgctgtctggagaagtctagctaagtagtcagtcagtgttttcctttgatatcttttaaatgcaacaaaatctgatgcaaattataggcaaaaacatcaggacggcaatattgtggtagatatggctagtctcttgtttggggacagacattaaacactacagccatgcatgccacactggcaggaggagctccaccttgtgaccctccaaccaggccctcaggccaaccttggagaacacccagcagagacactgaaaaccactcccagtgaggcaggagaatagggactggagttaaggaccctaaggccatttcatgctgacttcctagaactaaattgaaaggaaaaccctaactttccacgcctaagtaaccaaaggaccagagactactccctttccaaacccccaccttttctggatggcagatgggtaattgaaagtacctctcattggttgcaaaaagcaaaagagtgtaactttgcaaaggagtgtaactttgtaacttcactttagcctctgattgcttgcaccagtcagatgtttgcataggagtgtgacctttgtaacttcacttcgcctctgattgtgggccaccacttcatttacatggggtgaacatcaagtggccaatgggaactctctaggggttatttggacccaagaagattctgtatccggggatcttgagccgctgctctgccgctcccacacagtggagtgcactttcattttcaataaatccctgctttcattctttcattgcttcattctttccttgctttgctgtgcattttgtccaattatttgttcaaaacttcaagaatctggacagcttgcagtcaagaccttctactgataacaccaatgccccaatagcaaaaggctactggctcactgcaccccctttcattgatgctgccaaataccaactgacctagaagtaaaagaacactttacactccaactgctggaccttatcagcaggttaggttgagagagatttaagttaagcttagcactccaagtctatgatgggttaaatcccaaagcctcaaatctctcaagatattcttcccccatccctgctgtaattgaaaccttggctgtctgctgacccctttcaagtgcgagctgtttattttctcatcccccccacagctaaatgcctcagggagtgccaggaggtggagctcgagctctcgtcgctccccaagaccactttctgatctttgttcctcctccctcctgagaaatctttggttcttccttggctcatgctatccgcttgtatcatcctctcccattcctggtagcagtcttctataccttcccagtcactaccctcatttgtgaagaatttagttctgtactcacagtctctctgtcctctttgtcccagcttcccctgtcattctcagtgatttcaacattcacgtggccaataacccagcgtgcacacctcatgtttccttgatctgcccattgcaaataactactgccattttgggacatacttcacaacccagagcagcaagatggggccttgtatcttgaaggttcataaacttcaattaatttttttcattggtacaccagcacatggtttataaaagttgacaactctttagaacaggaaataggtaaaagtgtgtattgtttttattagaagttgggcctgtgcttcattctttctgttttgttttctgttaaactcaccgtgggtcagtgattacaaatgggattttattttatttttatttttcagagatgaggtcttgctgtgtcactcaggttggagagcatagctcactagggccttgaactcctgggatcaagggagtctcccacctcagcctccacaatagctaggactacaggtgcacaccaccacactcagctaatttttaaaattttttgtaaagacgacatctcactatgtggcccaggctggtctcaaattcctggcctcaagtgatcctcctgctttggcctcccaaagtgctgggatcataggctgagtcaccatgcccagcctataaataggatttttaaatgtcacagtagatgaagataaacccctaatgatccaaagatacatatgcacaaggtcattcatcacaacattgcttaaaattgcaaaatattggaaataatataaatgtccatacataggtttatagttgaataagctatggtacatccatacaatagaatactatgtggctgtaaaaaaaaaagtgagaaaactctctacaaactgaagtggagtgacttctaaaataaagttacagtgaaaaagcaaagtgccaaagatatgtctatagaatgctaccttttaggtagtaaataaaaggaagcattttcatacaaacatctgtacatgaatgttcacagcagcattattcataatagccaaaaaccagaatcagaccatcaacggatgaagggatgctatcatttgaatgtgtcccctccaaaataaaggtgttgccaatgtgatggcatcaagaggtggtgcctttaacaggtgattaagccattagggcttctccttcattaaagggaataaggcccttataaaagaggcttcatgtagcatttgattagtttgctattccaccttttgccatggggtggtgcagcaagaaagactcaccataccagatgccagcaccttggttatggactttccagcctccggatctgtaagcgatcaatttttgttctttataaattacccagtcttggccaggcacggtggctcacgcctataatcccagcactttgggaggctgaggcgggtggatcacgaggtcaggggttcgagaccagcctgaccaacatggtgaaaccctgtctctactaaaaatacaaaaaaattagctgggcgtggtggtgggtgcctgtaatctcagctactcaggaggctgaggcaggagaactgcttgaacccgggaggtggaggttgcagtgagccgagattgcaccactgcactccagcctgggcgacagagcaagactctgtctcaaaaaaataaataaataaataaataaattacccagtctcaggtattttgttgtagcagcacaaactaaaacaatggataaacaaattgtggtacatccatactatggaatactacccagcaatcaaaaggaagaaactattgatgaacacaacatggataaatctcaaaggtattgtgctgagtgggagaagccagtctcaaaaggtaacatgctatatgcttccatttatatgacattctcagaaggcaacatgatagagatagagaacaaatctgtggttgcccaggtgggggttggggaggccttgactacaaaagggcagcacatgagaagttgggaacagctctggatccttattgtggtagtggtcacaccagcctatacatgtgctcaaattcctaggactctacaccaaaatatgatgtgattatgctgcatatcaattacaaaaagtatagtggtggaatttgtggtaaaaatgttatgactttaatcgtaggtcttcagatagttattagagatgtatcactccaacacttggaccgtctattggtataaaaaaaaatactggccaggcacggtggctcacacctgtaatcccagcactttgggaggctgaggcgggcagatcacctgaggtcagaagtttgagaccagcctgaccaacatggagaaaccccgtctcactaaaaaaacaaaattatccaggtgtggtggtgcatgcctgtaatcccagctactcaggaggctgaggcaggagaatcacttgaacccaggaggcagaggttgcagtgagtcaagatcacaccactgcactccagcctgggcaacaagagcaaaactccgtctcaaaaaaaaaaaaaaaaaaataccagcagtgccaggcacagtggctcatgcctgtaatcccaacattttgggaggccaaggcaggaggaggattgcttgagcccaggagttcaagaccagcctgggcaacatagtgagacctcatctctacaaaaaaattttgaaaattagctgggcgtggtggtatatgcctgtagccctagctactgcagaggctgaggtgggggtatcacttaaacccaggagttggaggttgcagtgagttatgatcatgccactgcactcccgcctgggtgacacagcgagaccctgtctctgaaaacaaacaaacaaacaaaaaaaaaaacagcagcaaagaaactaaaagtatcatgcaactcccatgaaaaataactgaaatttggattaccatgacctggtgtattggtccattttcacactgctgataaagacatacctgagactgggcaacttagaaaagaaagaggtttagtggacttacaattccatgtggctggggaggcctcatgatcatgtcggagggcaaggaggagcaagtcacttcttacacagatggcagcaggcaaagagagagcttgtacagggaaactcccatttttaaaaccatcagatctcgtgagacttatccacctagaatggaaggacatttcatcatcacctaaagctaaacacaacaggccaaaggcaaaagctatggaaaccacattttataaggttgtactgaattgcaaaggttagacctactgaattcattgttcacacacttaccaaaactgctgccaaagacatagtgaaaatgatgactgggaacaaagcaagtgtatttgtcaaatatcacagttctttttaaaattacagatgtggctggaaacttaaaatagcaaatatccaacttctgaggaagttgatattatttgctgcaaattgatgagtctactgatcttgtgaatttagctaatattttggtatttatcatatttaacttaagccacttcatgaagacatcatgttctgccaatcttttgcaacttgtacaactgaagaagagatttccttctcttccttccttccttccttccttccctccttccttcctttcatctaactaatgattgctgggcactaatgtgccagccaccattgcaggtaacaaggacactgctgtgaacaagagacaagatcccttccctcatggatcttacattctggtaggtggaaacagacaataaaatgacaggaaagaaaaacagcagacagggataaatgctatacagagaattgaaatggggcaatgtggtagagtgaatgagggccctgtagatggggcagtcaggcaaagccctctgacaggaggtaacatttttttttttttgagacggaatcttgctctgtcacccaggctggagtgcagtggcacgatctcggctcactgcaagctccgcctcccaggttcacgccattctcctgcctcagcctcccgtgttgctgggactacaggcgcccgccaccatgcccggctaattttttgtgtttttagtagaggcggggtttcaccgtgttagccaggatggtctcgatctgacctcgtgatccgcccgccgcggcctcccaaagtgctgggattacaggcatgagccaccgcaaccggccgaggaggtaacatttaagttgagctctgaacgacaaaaagaaatcaactctgcaaactggggaaagaacattccaatcagaggaagcagctagagcagtggttctcaacaagaatagcaccacctcctaggaagcattttggaaatttgcggggaagagtaccacagtgattggggtattctgctggcatttactggagaaaggccagggaagctgcacatctgcaatgcgtaagacagtcctgcatccttcatggctctcaaagatcccatcagacattcatgtaggtggaaaacctgtttacaattatctgtgtcaagaacttaactttgctttactgctaaagacaaaacattttttgcacagtgtttttgtacatggcattttccaggatcgcaagtaccatgtaaatagaaggaaggttgtatcttgtttgtttctttcagaacttcatcaagagttgtttaacattaaaaaaaaaaaaaagttgccggccagctgcagcggctcatgccagcactttggaaggcccaggcgggtggatcacctgaggtcaggagttcaagaccagcctggccaacatggtgaaaacccatctctactaaaaatacaaaaattagccatttgccgggtgtggtggtgggcgcctataaccccagctactcaggaggctgaggcaggagaatcgctggaactcaggaggcagaggttgcagtaaaccgagatcgcgccactgcactccagcctgcacaacagagtgagactccatctaaaaaaaaaaaaaaaaaaaaaaaaaaaaagttgccaaggaaataaagatgtgtcattaaaaggaaaaaaatctcaccaatggcaaggcaatgtcacagaaaacactgcaccttcagagaaaattgatggagaagagaattttttaaattgatgatacatggccacggcaaaacaaaacaaaacaacaacaaaaaaaaaaaacaggagaaaaaggtaaacagtataaaaaggcacacagggttgggtgcggtggctcacgcctgtaatcctggcaccttgggaggccaaagggggcagatcacttgaggtcagtagtttgagaccagcctggccaacatggtgaaattccgtctgtactaaaaatacaaaaattagggccgggcacggtggctcatgcctgtaatcccagcactttgggaggccaaggcaggtggatcacgaggtcgggagatagagaccctcctggctaacacggtgaaaccccgtctttactaaaaatgcaaaaaaattagccaggtgcggtggcgggcgtctgtagtcccagctactctgaaggctgaggcaggacaatggcatgaacctgtgaggcggagcttgcagtgagccaagattgcgccactgcactccagcctgggtgacagagcaagactccgtctcaaaaaaaaaaaaaaaaaaaaattagattggtgaggtggtggctgcttgtagtcccagctactggggaggcatgagaattgcttgaacctgggaggcagaggttgcagtgagctgagatcgtgccactgtactccagcctgggcaacagagcgagactctgtctcaaaactaactaaataaatcaataaataataaaagaaaataaaagggcacacagtcaaaactcaatctcccttccacctctgttcccaagtctccaggtttccttccccaaagataacctgattatcagttttttgggtatccttccagaggaattatttcttttctgtttcaaaggaaggaaagaaggaaggtaagaaggagggaagagcggaaaggaggagaaagcaaccccatataaatatttattggtctgagcatgaaaaaaaaatatgaggaaaaacattcacacacgcaccaagctcttaaccgtggttacctcagggcatgggcaggggaacttaactttctttaatacacttctggactatttgtcttgttacaacaggtataaactactttataatttacaaatttcccaaaaagtaaaaaataaaagaaaattaggagagcaggaatcaatcaacattagtataaatataacaagataaattatattctaagaaatactagcaagttaaactaaagtaatgtactgagagatttcagttggtgagaagataaactgaaaaatgaaagctggagaatttaaaaaactgttagcatctcccaagccctgactggggcaacgagaggctgcctagggcttaactctcagctggccacctttctccttatattgcaacataacttctaagatttttttttttactcactgcctcttcctttttagttatcatacatttatttttagcatagcaccccaatttcacatcatgtacattttccaaagttggagcttgttaacctactatgctctccacagacttttcaacaagtgtgaaaaagaggcaataaggttggcttgagtatacaagtcacaatccaaatacaggatatcctcggagatttatttatgtttaggatgaatatacataaggtgcccaatgctaagcagatgaatgagactctggctgagtaaaatatgaacacctggttagcacatgatcatgaaaagacagaaggcatccaatatatagtttggtgttattcattttatgcttcagtgtacctgcagtgaaaaatatacattttactttctttttttttgagacggagtctcgctgtcacccaggctggagtgcagtggcgtgatctcggctcactgcaggctccgccctccagggttcacgccattctcctgcctcagcctcccaagtaggtgggactacaggcgcccgccac[138 bp omitted]cccggccatacattttactttcaaggttaaaataggccaggcgcggtggctcatgcctgtaatttcggcactttgggaggccgaggcaggtggatcatctgaggtcaggaattcgagaccagcctggccaacatggcgaaccccatctctactgaaaatacaaaaaaattagttgggtatggtggcacatgcctgtagtcccagctacttaggaggctgaggcaggagaatcgcttgaa[142 bp omitted]ttccagacccacgaacttcctgaaagagctttagaatcttgtcccgttatccaacaaagggctttaggaagtaccagtacccgaaggtttccttattgtaatccccaaattccaattcaagcccttttaaagtcggggtcctccggtcttcagagtcatacatctttctcaagcttcccccagccatcaaattagcttacaacaagacagaagaattcacaaaacatgaaaataagcattccccaattgttgagagcagagtatggcttctgcaactagaacaagttctcacagtcaaaaccttgtaatgtcatactcaagtgagattgacagtgaaaaataaaaaaggagaaaccctgcaatgccttttagaaaacgttcctatagcattgtgtgttagtaaatgtaaataactatacaagcctaaaaacaactatgtacccggaacatcttgctcacaccaacagactgctgacagttcctttccttgtaattattagtgacatggcttttttagaaaaaaaagagacagaaagaaattctgaaattctgaaatttttgaactgattaaagaatcctcggattctggccaagcctctcttagccattctttgcctctattgttctcttagcttacagaaccactgaaaatgtccctactggagttaactctgcagtcctagtagacatatagtgtagccgttagtggaaactgacataaaccgccctagatttcaaaccggtctctgctttgtaggtagctgtgtgagcctgagcaagtcctctctgtgtcttggtttcctctcctgtaaatgaatacctaatcagaactaacacatataaactgcttacccataccagtcattgttcattaatccttacaacaacccctaggaggaaaaaattataatctctgttttataaagcaactgacacacagagaggttgagtgacttccccaaggtcccacagctggtaagctgcagagccaagaatcttacacaggttcaagagtccagattcaagtccccacacccacacagcctctgtcaatgaggacatacgtacttagggccgttttgaggattacatgagaacgtctgtaaagcccagtacttgacaagtgcctgagagatagcaactgtggttgttagaattttttaccttctgcactgggaaaccatcaaggctttttggttaggcaggaaaaaaaaatgggttggaggcaagaggaggaggagggaagcgccaggggaggaagacagagaagtggcacgtgaaagggagaaaaggggcaaaccagaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaagtaagagccgggcggggccggggaaccgggagaccggacgggggtggggtgggggagccgcggcccgacgccgccctgctgcctggactcggggccctggagtagggacggcccccttgtcgatcacctggggacccctcggggcggtgggccacctctatggcccccagagtgcagccccaatgcttttcacgttctcttggggttaccgccctgcaagatgcagttttgtggtccgcagccctggtccgagaggctttccggattggaccgggcgaggaggtggaatgcagcaaaggatttggaggaaaggaatgaaaagctctccagagagatgagtcctaaccatttccaccgtcctccaatttggaaacttttgcttaggctggcttaggaagagagagacccttttaaaggtgtttttgtctgtgtgacccaagccccgagaagaaagtgcttggtgtggggaaaggacccgatccatcgatacgaaaaggccgcagatttttgcccacacatctccccaacttaaatgaagcttgacttcaggctccgacagaggctgcagcttcccctccccaagctgagaacggccccctcagcctaccgcttcaccccactggcctcatttatttgggccttttccaccttctcccacatcaacagctgctccttaggaaaagatctaaaggtgtaaatgcagccttaaagcttccaccgagctcagaggtacctgcatttgaactggaaaccaagcctgaaagaatgaattggtagtgatggcatttcaggaagcagagatgtttctgtattggggggacggtccctgtgttcctcattcagtgggcacagtggcatctttgatatcgccttggctctgaattagacaaacagcccacatttgggagagtcggtcttgaccgcatagtttagtcttggcggctaatagtcaaaggattttgccttgacactgtcactcacctgggaggccagaggtggaaggctcacctggcagccgacaagccgaacggaatcatccttattacctaggcctctaggccagtactcattttgcctctgcctggaaatagagttcccttctcttcctctgcagagggactcatgggtgggaccatgacatttagttaaggccctttttcctccccacctctgcttgccctcatcaacatctggcctgcagtctgtaaacagttctcctctgagtcttaatgactcagtttctcccccacttcaccctcttctctacaaagtagtgtggaaatcttcctttggatgggataaaatatgtccagaggggtggggggcagaacttcaaaggctggtttaagtattgtggctcttctgctaagcacctagtatatgcacattagattttttaagctcctgcctcctgccctgtaaggtccataggacaggaagcattgtgcctgttttacagatgcagaattgggctcagagtgatgacacctcttgtcagtgaccgagctgagctccactacctggccttctgactccaaatctcatagtctttctgttacatcatgctgcctccctgcatccatttgacactaatttagtcaggctacattaagtccccactgtgtgcacgatgctgaggacaatgccaggatggaaggggcatggtccctgtgccccaggagcttacagagtaatagaagagtaagactaatatgtccatgaccataacacacaaggtagcatgtgattgtcatggataatgtgctctagaaatgtacccttctgatgagcgatgaggaggagaaaatgtgaagacttcatagaggagaaaaaaatttgagtttggcattgggagaatgaggagtctgctgggcagagatggagagaaagatactgcagttgatgtcagcaaatgcacagaggtgggaaggcaagcagcacaacaggaagtccaaccagaaaagcaggttggaatgagatattagagggttggattaagggatttggacttgacttggtatccaagggtagctgtgggaggtttttgtggggggtggggggaggtgtgttgtgattaaagcaattcaatggaaatgatcgtcacatcgtggcagagtaagatgactagagaggaggaagagtggagacagcagggccagttaggaacctgttgcactagtccacatagcagctgagggcaccggcaataggtgaccatgggagcagagaggaggagatgtctgggagaacgagaacagagacttacctgggctaggtttgctaggaattttttttcccctacaggattattttctttctgaaaactaaaaggaagtattttggtgaatggcaaggcatagttggaaagcaaagtgtttgattaatcgcgatgccatccttcctacatcaacatgatactcttgattcatcattatactgattcatttctactcttttctgaccatgaatttgcaaaacagttggctgggggcctgtgatcatgggtttgaacaaaacataaacatccagaatgttcagggaatggggtagttaagtgacttgtccacaaatgcaattaatggaagagctggaacttgaagccaagtcttctggctccttagttcaggtctctgtctaccattgcacagcagaaatatctgcttagttggattgacgatcaagagtccactcagtagtctgttgggagctaggttattgtaatgggtggctttcagatgtatcaaatagaagacccccccgccctggaacttcacaaccgcttgtctatcttatctaataaacgttagtttgggtccctgcagctctgaaattgttcataaccaacactatttctttattgaataagcacttcatgagcttatgtttggctgcactggctgccaacctgttaggttgaagtattggcagttataattacacatatccagggtgtgtgttgtatctgtgctggctgaaaggaaggggttgctgcaattcaccagtgtatccagtctcactggaaaaagcttctgtgcatgtatgtgtgggggtgggaggaagaacagaaaagggaacagtgccgccctagcaaatcaaaagtttaagatgcatggactgagatgacatcattggcggattatcagggttgcctgccctgactctgagattctaaggggaacaattgataggacttatctctgtatcagatgggagaagtctgcgaaaaaaggacttcctatggttcttctttttaattgtgtatatttgatattgagactctataaaagaaactgatataaaatacggctcctcttcctagttcatcaagtcattcagtgaattaagggcctgtttcctctccgcttgcccctaccagtcatttccttgtcagaagtgttgaactcccttaggctctatgctgaggactaacacagggtctgatacattgtagaccttcaataaatgagtagtgaattaactatgccctagaagtgaccaagtgggatggggaataagagtgggacaaggagaatgaatggtatttctttgggcatttcaaactccaccttctaggtggttccagcttgctgcagaccgcccctccagtcaaaaatttctttttttttttttggaagaagtattgctctgtcgcccaagttggagtgcagtgacgcaatctcggctcactgcaacctccacctcccgggttcaagcgattctcctgcctcagccttccgagtagctgggattacaggtgcacgccaccatgcctggctaatttttgtattttcagtagagacggggtttcactatgttg[132 bp omitted]tctgaggtccccctccaacttgactggccagggtatagaagagggaggaacgaggaagtgggcaggcaggcagtacaactgaggcagatagtctgttggtgaatgccacctgtttgagaaaaacctctgtcaaacttggtttttcctctgctctcacaccacaacaacaaccctcaacacagaagacttctgtgaccaaatgagtgtggggaaccccacactctgataaatggacaccaactaggtgtcctctgattcagttctgacactgtctacctggacataatgtcagaccaagccacaggttaagggcttggtccccaagaatggcccccaaccagacactagtcacaagtccaggcctccagaacttttttttttttttttttaagactgagtctcgctctgtgacccgggctggagtgcagtgcgtgatctcggctcactgcaacctctgcttcccggattcaaactattctgctgcctcagcctcctgagtaactgggattacaggcgcccgccaccatgcccagctaatttttgtaatttttttactaaagagaaggtttt[133 bp omitted]caagttggggttcccacgaccccctctttgggttcgattaatttgctagtgcggctcacagaactcagggaaatagttaatgtttaccagttaactacagaggataccacaaaggatacagagaagagatgggcagggtgaggtaaggggcagggggtgtggagcttccatgccctccctgggcacgccacccttcaggaacctccacatgttcagccatccagaaggttcccaaaccctgtcctctcgggtttttatggaagatttgttacagaggcatgattgacaaccatgtagaaatgtgactggatgaaaagcacatgatctaaacccagcaaggcctgtctgttcagacttttcttggcctctatgcagcgttcctttctctagggcagaggtgtccaatcttttggtttccctgggtcacactggaagaagaattgtcgggccacacataaaatacaataacactaacgatagctgatgagctaaaaaaaaaaaaattgcaaaaaaatctcataatgttttaagaaagtttgcaaattggtgttgggccacattcaaagccatcccgggccacatgcggcctgtgggctgtgggttggacaagtttgctctagggtatggggcaggaccctctctgggatgaggatcttttaacccacaatcagattagagtcctaccttgggcaggtaaaaggagggcaggagaaggtcaaagagagaaagattctgtttcctgagacctaaagtgccccaacattataacaaggactagggaagttaggagccaggaaccatgggtgaaaaccaatgtatgtatcatagcaccacatcacctttacttccctgtatgtttaaaagcagctgattaactcaaatgactgtttcagttaatgcggctaaggtaggttgacaaaatgaagtcaagactcctacagcttgaagatgtttttaatcagtgagtgtttacttgaaagcaaaagagctagcctagaaccccttaaatgctttcacctgaatgcccactcttatttctcatgcagcagcccctggcctatgggcaactgaaagaacaggaaatgcacctcctcactggaggtttgaaggctaaggaactggggatgctctcattttaaaaagataggccgggcacagtggctcacacctgtaatcccggcactttgagaggctgaggcgggcagatcacttgagcccaggagtttgagaccaggctagccaacatggcgaaaccctatctctacaaaaaaaaaaaaaaaaaaaaaaaaaatagccaggcatggtggcgcacatctgtagtttcagctactcaggaggctgaggtgggaggatctcttgagcctgggaggtggatgttgcagtgagcccagatcatgccactgtacttctgcgtgggcgatagagtggccaccgcacccggcccagaactgggcactttgggaggccgagcggggtggatcacctgaggtcaggagttcgagaccagtctggccaacatggtgaaactccgtctctactaaaactacaaaaattagctgggcatggtggcgtgcgcctgttgtcccggctacttgtgaggctgaggcatgagaattgcttgaacctggggaacggaagttgaagtgagccgagatcgtgccactgcactccagcctggccaacaaagtgagactctgcctcaaaaaaaaaaaaacgtaattactgagatgctcgaagttatcatttgaagaaattttgttcctttttaagtttcaacagaactgaaagactgcactccagttggtatttaccaggtacttctgtgcatttacaccccacaggcaagccagtgttgacaattatgtagataaaagtagaaaatgctttaagtgggaaggacttgggatagatgtaaattaagaaagttaggcatctcttatagccaactagcatcatataaatatagaaaaatgtaaatgtattattcatgaatgcttatatagtactatagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtaagatggaccttttcaccttgtccaagaaaaggctatgttctctgaaattacaaatgtattgtatacctttgtgagccactaaatcagttttactgagatcaaggttatatggattcaacctacatagaggcaattagcttcattctattccatagccatacactccactcctaaactttggccagttacatccccgggaggggagtagaccagaaagtggaggtgactcagcaaactggtaagaatgcaattctaaccactctccatctgactgcagaaggagtattcagtgtacatacacattgatatgccatgagggcaactagggtagcaactgtgtcttctggggtctttgtaacctttgccagagctacacatttatggcccaattgcaaaatccagtagactttttccctttatctgaacttggttgcagcatttgataaggttgaccaccccttcttctggaaacttggcttccaggacccctccaagtcctgggtgtcttcccatctctctggcagctctttcttatctgacttatccggcccatctgggtcgtctgatactgccagcccctacatgttgctcttcccctgggctccttccttagctttctttttaccctcccctttagcttgcttctcatcctccaaaccctccctaggtggcctcatctatgctagtggcttaagcaagcgtcagtgtattctgtgacccttattctctacctctttagtaacaatggccaacttttggggggaagtacttaccatgttctgggtactgggccaaatgcattgcatgcgctttctcatgaggccttattttacagatgaggagatagatgcttcaggaagctaagtgacttgcccaagtccacatagatagaaagcaggagaaactagcaatagaactccagagccctctgttagcccctgactgacaccaattcccaatggtagtatgagtccctgctgttggacaccttcacctccatgctccctaggcacatcaaattcaagattaaccctgatgtcctcgttggtctcaaactagctcttcctcctgtgttccctaatgaatgagactaccttcctttcaccccgtggcccaagccagaaaaaaaagcctagggatcacttcaacttctcctctcactccacccccacttgaatcaccaagtcccgtcgatttgactcatcctctttcccacaggtccttacaactcagactctcagggtctcccacagactctggctcctacctgcttccactcttggtatctcctgccccagtcttccccgtgcactgctgcccggctgaggtgatctctccacgtgcaatttcatcgtttcacggccctcatttcactgctctccttaaaaagtattcagcgactcctgagctacaggagaaagcccaaattccttaggacattctagatccttcagacctggcccctgccagtttgtcctacctcatctcctgccatacctccacctgcattcatgctccagcccttcagaaaaacttggatttcctggaaataccactccctttatacatgctattccctttgcctttccactctgtcaaagtctgatgaactcctatttattcctcaagacccagttcaaaagttctctctttcatcaagtccctcctgactcccccaggcaaaattaatccctttgatccttgtgtacctaatgcatttcatatagcccccctgttgtggcacacatcaggggtgttatactgactttgccctggctgtctgttctcctcgatgatgagcatctccagaaattagcccgctcctctttcgattcccagcacctgacatagggcctggcacataacctaagctttccagacattttctgaatgaaggtaaatggaaggttggtgagccaattaaataaacattacatttttctaaagataagcaatttcacttgtattatcccctattttaaatttcattttgagggagaaatttagtccctctgtaaactaaagatggctcctaaaggttctggaagtttgtgaaagtgccacctactatattacttactcaccatctcagttcttagaaaggtgaggaagccacacagtgtagggtgcccactgggccatgatatgaccatgtcattcccaaaggtgaagtcaggtgacctccctcaccatcgagagtctctcactttccagttttcataaaatgtttccttctcagctagagatcagtccctcctgtcctccaaaacataatgaggtgctgcccactggctttttttacttgagtgattttttccccgaacattaaaaaaaagcttcaaacatctagaaaaattaaaagaaatctagagtatacatccatggaccatctagatgctacaattaacattttgctattcatccctccagccattcatcagtccatttttattttatttatttatttatttatttatttatttatttattttttgagacagaatcttgctctgtcacccaggctggagtgcagtggtgcaatctcggctcactgcaacgtctgcctcccaggttcaagcgattctcgtgcctcagcctcccaagtagctgagattacaggcacgcacctccacgcccagttactttttgtatttttagtagagatggagtttccgttttagtagagatggagtttagta[137 bp omitted]taacttgcaaatatcaatacacttcacccctaaacccttcaacatgtgtgtcattaactagagttcaatatttgtgtatggttcttttttttgagatggagtttctctcttgtcacccatgctggggtgccgtggtgcgatctcagctcactgcaacctctgcctcctgggttcaagtgattcttctgtctcagtctcccaagtagctgggattacaggtgcccaacgccacacccagttactttttgtatttttagtagagatggggtttcaccatgttggccaggctggtctcaaactcctgacctcaggtgatcctcccgccttggcctcccaaagtgctgggattacaggcatgagccaccacgcccagccgtatggttgttttttaaagtacaatttacatccagtaaagtggacaaacctttagtgaaccatttgatgcattttgacaaatgacacaacccctaccaaaatatagcacattatcgcactcaagaaagttccctcatgctccttgggttggagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggtgaggagttatcagagtggggtagggggtggaatgctttgtagtgtttgtggtcgggtaataacagcaaagaacactgaccccaagtgatgccaggtttccaaggagcttctgactgctcataaatactgtgcaaacccccactctgtggcatttctgctgctaacctcagagctgttggcttgagccccggctgcctcctcattcccatcctctgttttttggtcttttaagaagcctccaggctaggggcggtgattcacgcctgtaatcccagcactttgggagggcggaggcgggtggatcacttgaggtcaggagtccaagaccagcctggccaacatggtgaaaccccgcctctactaaacaaacaaaaattagctgggcgtggtggcaggcgcctgtaatcccagccactcagaaggctgaggcaggaggatcacttgaacttgagaggcagaggttgcagtgagctgagatcgcgccattgcactccagcctgggtgacacagaaagactatgtctcaaaaaaaagaaagaaaaataagaaagaaagaaaaaaaagaagcctccagatgaggcttctcttttctttcctgacttcctgattatatcacttgtggctctccttcctccaagaccagcagagagtagaatatgaaatgcagcctgctaatgctccctgtccttgctgcctccacagcaaggatgccactcttggtttcctcactgtgccttacctcagtgaagcagactggataggaccaacataagctaggaactgtagctaacaagggtccagcatccctgactccctcgctgagga[132 bp omitted]agaaaccctgtctctactaaaaatacaaaattagctggttgtggtggcacatgcctgtaatcccagctactcgagaggctaaggcaggagaatcacttgaacccgggaggcagaggttgcagtgagccaagattgcaccattgcactccagcctgggcaacaagagcaaaactctgtctcaaaaaaaaaaaaaaaaaatgaggcggcatcttagtgagaccactgaggcaaaatcctagaatcagaagttccaaagtgagtaattgtcttagcctagaataagccaattttgatcaaagaaaaatcagactagttcaaataaggttgggtgggtaacagttatatctgtacagtgggggcaggcccagaatcctagcagggctgaggtgctgtatcttctcttagccctgctcaggcccttaaaattcaaaaatagctaatgcatgctggacttaatacccaggtgatgggttgataggtgcagcaaaccaccatggcacatgttcacctacgtaacaaacctgcacatcctgcacgtgtaccacagaactaaaaataaaaatttttaaaaaaattccacttccataggctaggctgtctccatggcctcttctgggcaaaccctgatttatacaagcaatatattcctgaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctgaaacttcatctgtctgggttgcattcctttcctgtccttgtccaaacagataattgtcgcatcattgtaatggtagtataggtgcaaaatttttctattcgttggtaagaagtctttatatattaaagatattaaccctttgtcatacatttcacacaatttttccagtttgacatttggtgttttttttttttttgagagacagagtctcactctgacacccaggctggagtgcagtggcacaatctcagctcactgcaacctcctcctcctgggtttaagcgattcttctgcctcagcttcccaagagctgggactacaggcatgtgccactacacccagctaatttttgtatttttggtagagatggggtttcactatatgttgaccaggctggtctcgaactcctgagctcaagagatccacccgcctcagcctcccaaagtgctgggattataggcatgagccactgggcccagccaacatttggcttctagtgctatttatgtgttgttggtggtggtgctttgttgtacatatttgtagaattttatctaattatatctattacttttttgtttgtttgtttctgactttgcttttctgcttaaatgtaaagtctgcttagtgcatgcttatcttttttttttaagtatttctaattttaaaaataatgcacatttggaaggccaagatgggaggatcacttgagcccagtagtttgagaccagccttagcaacatagcgagaccttgtctctactaaaaataaaaaattacctgggcatggtggtgtgtacctgtggtcccagctacttgggagactgaagcaggaggattacttgggcccaagaggtcgaggtcacagtgagctataatcctgccaccgcattccagcctgggtgacagagagagaccctgtctcaaagaaaaaaaaaagtaatgcacatatactttaaaatggttaaaatggttcattttatgtatatttgaccacaatgaaaaaaaagtaatacacataagttgtagaaaatttgggacatacagaaaagtgcaaaaaggaaaataaattacccatagcccaacacccatggattataatgattaatagttttccttctatggaccttcatatatatacataaacacactcacacacatataaagatatataaggttatttcttttacaaaattgtgttcacactgtatataaaaattagtatccttaggccgggcgcggtggctcacggctgtaatcccagcactttggggggccgaggcgggtggatcacctgaggtcaggagtttgagaccagcccggccaacatggcgaaaccccgtctctactaaaaaatacaaaaattagctggtcatggtggcacatgcctgtaatcccagctacttgggaggctgaggtaa[136 bp omitted]taatgggtatttccctgggccattaagtatttaattatcaaataatattccaccatatggatgtgccaaaaatatgtaacaatttctcctttttttaatatttaggctttttctaattcttgagttatactaacattgtaatgaaaacctttgcattttttcatatctgtgatgatatccttaggctatattcctagaaattgacttataggtcacaaaatatgaacaattctaagactcttcatgaaatgtgcactccagaaaggttgtaagtttgtaattccaccagcactaaagcagtggctcagcttctaaactctcaatattcattgatattaattatcaatattaattgtcactttttaaatcattatgaacctaatagctgaaaaatagtatcccatcattttaattttaatttgattgattataagcaaggttgcactggccctttgtatttctttgtaagttttgtatttatgtccttgccctatttttctagaatattcaactttttctattcattggtaagaagtctttatatattaaagatattaaccctttgtcatacatttcatatatttttcccagtttgacatttggcttctaatgctgtttatgtgttggtggtggtggtgggtttttgttttgttttgtttttttagacagggtctcgctatgtcgcccaggctggagtgcagtagcagttcaagcatttctcctgcctcagcctcccaagtagctgggattacaggcacctgccaccatgcctggctaatttttgtatttttgatagagacacggtttcagcatgttggccgggctggagtggtgatgttttgttgtacatatttttagaattttatctaattatatctattagtattatcttctgtttctgactttgcttttgtgcttaaaaggcctattctatcccatgatcctatgactattcacttatatgttatttaaatacttttttagttgtgatttttacacttggcttcttttttttttgagacagggtctcactactgcccaggctggagtgcagtggtgcgatctcagctcactgtagcctcgacttcccaggctcaggtgattctctcacctcagcctcctgagtagctgggactacaggcatgcaccaccacacccagctaattttttttttttttttttttttttgagacggagtcaggctctgttgccaggctgaagtgcagttgcaccatctcggctcactgcaacctccatctccctggttcaagcaattctcttgcctcagcctcctgagtagctgggactacaggcacgtgccaccacacccagctaaatttttttttgtatttttagcagagacggggtttcaccaagttggccaggatggtctcaatctcttgacctcgtgatccgcctgccttggcctcccaaagtgctgggattacaggggtgagccgccgtgcctggccatcatacccagctaatttttgtattttttgtagagacagagacttgccatgttgcccaggctggtatcaaactcctggactcaagcaatcctacccatctcaaactcccaaagtgctgggattacaggcatgagccactgtgcccagccttacacttaacattttaatacatttagaatttacctggtgtggcagggtgcagtggcttgtacctgtaatcccagcactttgggaggccaaggtgggcggatcacctgaggtcaggagttcgagaccagccgggccaacgtggtgaaaccctgtctctactaaaaatgcaaaaattagccgggtgtggtggtgcgtgcctgtagtcccagctactcaggaggctgaggcaagagaatcacttgaactcaggagatggaggttgcagtgagctgagatcatcccattgcactccagcctgggcaacagagcaagactcagtctcaaaaaaaaaaaaaaatttacctggtgcacaggtgccgtgactcctgcctgtaatcccagcactttgggagtttgagataggtaggatcacttgaggctaggagttcgagaccagctggccaacatggtgagacccgtctccataaaaaatacaaaaattaactgggcacacctgtaactggtgcacacctgtagtcccagctacttgggagactgaggagggaggatcacttgagccctggaggtagaggctgcggtgagccgtatttgtgccaccacactccagcctgggtgacagagcaagaccctatctcaaaaaaaaaaaaaaaaaaaagaattttcctggtgcatgatatgaaacagtcatctaagttttttttttaatagtttaccaattgtttaagcaccattttttgaataattcttttctccactactttgtgctgcagctttcaccacatactaaatgtttatatctattctagggtctctatcttaatgaccataactttagaaaaatgccttttttttttttaatttttttgaaatggagtctcgctctgtcgcccatgctggagtgcagtggcgtgatctcagctcactgtaacctccgcctcccaggttaaagcgattctcctgcctcagcctcccgagtagctaggactgcaggcatgtgccaccacgcccggctaagtttttgtatttttagtagagacaaggtttcacc[139 bp omitted]attgtttttcttttcaacatttccttgattattttcgggcatttgttcttcctgataactttagaattaccttgtgattatgattggaattatgtaaaacccatacacttggagtaatttatgtaaaatatttcatcttttattcagagacacagtatgtctctcctttactttcaatcttctttctttagcttgaaccagatgaaattaccaatattcaactttgttgacatcattcaaacagcaatttcatctggttcaaaccttagaaaagttgttttcttcaaagggaaattatgctctctctaaacaaacaaaaaaatagtttctcttaaaaaatctggggagaagtagggtaggaaagaagtatgatatactgtaagtgttttattcattttttaaaaatcctggtcctaagaatttctcactgccaggggcatctctccagcactttcagccacttcatgcctagttcaaggcttcgccagcttagcttcctccccatagtgggccagtccaaaacaaccagggccttgagcctcaaggggtagggctagtccgtgaaaaagggtttcaggccaggtgcggtggctcacatctgtaatcccagcactttgggaagccgaggcgggtggatcacctgaggtcaggagttcaagaccaacctgaccaacatgatgaaaccccatctctactgaaaatacaaaaaaaaaaaaattacccaggtgtgttggcacgtgcctgtagtcccagctactcaggaggctgagagaggagaatcacttaaacctgggaggcggaggttgcagtgagctgagattgtgccaccacactccagcctgggtgacagagcgagactctgtctcaaaaaaaagagaaaagaaaagaaaaaggtttcagatgaagttcaatgacatctaaatgggacgggtaagggtcccagtcttccccataaaccttagttttgctttctcttcctgagagctagaacagtgacctcatctgggagaatccagccaacaccgcattctacaccatctgcattctatacccctaccacaacaacccactataaactggggtaagatacactagaagtgggtatttgggggtaatcctgatcatctttttcctcgtatgggagccttccaaataatgcatatatagagcataagaagaagtttcaaatagatgcaaagtcatgatggttgtaaaaaaaaaaaaaaaatccaaagaggtaattgcactgttttcacaaaataggatcaacatgtaattatgaataacaatataaatgtcatccaaagatataggaagtgaacttttagggtttcagtgaaagtgttattttgcaggggttaataaacatactaatactttgtccaccctatgttaaaaaaaaaattcacccccaagacagaactgcaggctgcttttaaatgcaaacatggcattgggcttctctggccattagatgtcactgcagtaaatggagagtagctgagcatcacctgattggagcctgaagttcggtgatctctgtccagttaacaacttcataatccctgcttgaaatccatctttggtttggagaataagaggcctagaaaccacaggctaatgctaaacttgttggttttgttgttactgttacttgtcctacaaagcacacactccaaattcaccaagaagagagggctttaataacagtctgtcctcgctggagcaggcagggtttgccagcagaataagtaacgagggacctttgcagggccactgggctgctctgacctgagcacacttaatggcaacatttgcattccattggctttccccattgcactgcctgtcatgaagcaaatcaatggcaggtgtctgttggataacgagctacacagggaatttttctcgatccctgcactgactggcccctttgtctggatgtttctttctcttaatatgcttttctctagacacacacagcccatttaatggcacatcaggttggaactcttttgaacataatgacagtaatcagaagtcttgtttaaccagctgagcccttccttcaccatgcttacactcattttatccctttttccttttcttgccttggctcctggctggcatgctagagaatggagaggtaaataaattatgcatgtgcatgtcttgatagaatggcttctggtgggaaggggggtgggtcaggcctgtgcacacatggaatgaggtgcccccaacttggtgtgctttcacggaccccaaccaccctgcctgaaatccccttctccacgcttcagtgcatcttagctcaagcccttccaggtatagcctggcctttttgtctatctcccacacctagcccagggcctgggccagaagagatggcagaacttagtgtattgagagaacaagtaggaagggtaaaatattgacagagatgaattcatctgattaatctgtgcaccccgaataagaaccagggagtcctgagaaaatggctctctgcacaggtgcatgtgaagaagagagggagataggctggggaatactgccctgaaaatccagggagcagctgagaatgtaggagccttggaatctggcaggccttctgaaaggatcaggagggaggtaccagacacatgctcggtccccccacaactctgcctgacaccctcccctattgcccatattaggtgtctccatttcatcaaatataaaaccaagtgtgagcctgttgctttataccccagtggactttgaccccatcacagctcacaaggtaagcaggattgggccaggtcagcatttgaactgaaagcacataagatgaaggacaaaggtggtatccgagtggtacagctgactgagcagaatatacatggtcagtgaataaacagaggccccagcctactcaaatagagatgctcgacacctcgggttacctttgttgaattggacacagtcacttcattcattccctctcagggtgctcatcccctcttgtagtttttcatgttcatatctacatcttcaatcctgacctcccttctgagccatggtcccacatttcccacagcctgctcgacatcactatttggctatcatatccccactgtcacctctaacttaatgtgcatcaagctgacctcttcttttcctaacactgttattccagagttttccatttcaattccatcattgccccagtgactcaggctggaaatccacaacttgtgtttgactcttccccttcccctcacccggttaaccttgagccctgttgcttcttcattcctaacattcccatgctggtctttctttttgtcactgcctcttgccctaatcttggaccttatcagctcatacctaggctattacagtaatctcctcattggtctccaggattaattctaaaaatgatcttaagcattgaatattaatatgtactaggcactgtgctaagtgctttatgttcattatctcatttaatccttacaacagccctacaaggtgggcactgttattattaagtccattttacagatgagaaaactgaggcaccgaaaggttttgtagcctgcaagttcacccatccagtaattgagctgggatataagcccagggagcttgtctccagagtcagtgctcatttcaatcctctccagcccagcccatatgggattctgtcagatgaatctttctcagatctgtctgcgttagatccttttttttttttttttttctttttgtgagacagggtcttgctctctctcccaggctggagtgcagtggcacaatcacagctcattgtagcctcaacctcccgggcccaagcaatccttccacctcagcctcccaagtagctgggaccacaggcatgcgccacctatgcctgactaatattttaaatgttttgtagagatgaggtctcctggtctccttatgttgcctaggctggtctcaaactcctgggctcaagccatcctcccgctttgacctcccaaagtggtgggattacaggcatgagccactgtactcagcctgttgttgtgtccttcttgatggtccccagagaaaaaaggctgagccccttggcttggcatgtttcccttaccaactgtgcgatccttgttgcacagaggccctttatataagaagttacaaaaacaaatgcctgcagaaacttggaagtaacatgaaaaagagaatgtagggaaacccagataacatacactcaccctgtaaagaataagccttcaggctgggcctggtggcccacgtctgtaatcccaccactttgggaagccaaggtgggtggatcacttgaggtcaggagttcaagaccagcctggtcaacataatgaaaccccgtctctactaaaacacacacaaaaaaattagctgggcatcatggcaggtgcctgtagtcccagctactcaggaggctgaggcgggaggatcgcttgaacctaggaggtggaggttgcagtgagttgagattgtgccactgcactccagcctcggtgacagagcgaaacttcatctcaaaaaaaaaaaaaaaaaaaaaaaaaaaaagccttcaaatgcattccgagccatcatggctttcaaaagcattctggagagctaaacttcactgtgctcacaaaatgtgatttgcatctaaatatggatgacagaaaggaagaaagagagccagtagaggctgtggccagttcctcctctccaaaggacggatgccatttagaaatgtaggcccagttttcaaaggagtctaaaatccagatttttatgtaaaatctcccagtttttcactgctggcaaatgaaaattgttaagtactggctgggctaaacaaaacacacattcgtatgacctctgctctattcaagcctccaagttcatcaaactaatcttcttagccccttctcccaagccctgaagactaagtgcatttcacattccagtcaccaggcctttgttcatgaggttacctctgtcttggaacatctgcccaattttcttaaaggctcaactgaggtttgtctcagtgatggctgtcttttctgacctactgtagcacatacctgttgtttaagaaatgagttggcttttcccatccccaaaacagctgtcctatcttgatggatcaaggtagatgttttgcctttgtagaaccacaatggaggtgctccagcccacttcagaggggattctggggcaagagaagctgagttaactaacaatctactcagttaataactgcagatgccgtattttcactgtcccccacccaacccccaagggcatagttattttgttctaagagctttgtgggtgaataccacccaccccctttttatttttgagacaagagtctcgctctgtcacccaggctggagtgcagtggtgcaatctcggctcactgcaacctccgcctcctgggttcaagtgattctcctgcctcagcctcccgagtagctgggactacaggcatgcactaccacacccagctaattttgtatttttagtagagatggggtttcaccatgttgcccaggctggtctcgaactcctgacctctggtgatccacccgcctcagcctcccaaactgctgggattacaggcatgagccaccgtgcccggccaaataaccccttttaaatgatgctgttagcctatacgtgccctctgatccagccagtttcttttccatggcatttctgtccatgccctacctcttcccatcttaacactattgccctgctgttccctcactatcaaagccgcctcctgaagtcttctcccatctccccaagcagtagtctcccgctcctgaatggctcactcttgctagagctgtcttatggcccatgccacatgcttccttttgttataatcttttgtgtcccttatttcctctagattgcaaactctttgcctgtgggaagtatgtcttacacatttgtatatcctcacaacacacagcctcatgtagcagacatctaatacttgtttaaaaatgaagtttagggacagcttaggagatctcgctgtctgctaggtgagtcccaagtccgtgtggttgtacctacccaagatgaaggtaagaacacccaagcctgcctcctgctcaacctgctgccctaagaaaacctctgcatgtcccctgtctaaaactgtctatgcacttcgctctgagaatgcactgtcttccatctcctaccctagcaatcaggttctatgcatctcagtgcaaacagccgttaacgtttcaggatagacaaatatgctaaaaggacaaaaggaaaaattcttgacaccattttgatttacacctcctcttcattccagcctcctggcgctttgtatggtggctggaagtgcttgacaaatcatagcaccatcaaatttatacagtcgtccctaggtgtctgcaggccattggttgcagaatccctctctgataccaaaatccactcatttctcagccctgaagtcggccctgtgaaacctgtggacacaaaaagttggccctccttatacacaagtcccgcatcccaaatttgattgtggatgcagaacccacagaaacagagggccgactgtatttattgaaaaaaatccacatataagtgaaccagcacaactcaaatccatgttgttcaaaggtcaactgtaggccgggcgcagtggcccacgcctgtaatcaccacactttgggaggctgaggcaggccgatcaacggaggtcaggagtttgagaccagcctggccaacatggtgaaaccccgcctctactaaaaatacaaaattatcctggcatggtggcacacgcctgtaatcccagctactcaggaggctgagacaagagaatagcttgaacccaggaggtggaggttgcagtgagctgagattgcaccactgcactccagactgggcaacagagcaagactctgtctcaaaaaaaaaaaaaagaaaagaaagaaaaggaaaaaaaagaaaaacaaaagttggttgctttctgtaaatgtgaccagatttgaatgaatgcatgtaaatctatgctgtactttgctggggaggtttttgtcagggataaggatgggggcaaactatgttaagggaagtgatgacaagaaagccttccctgcgattaagaaattataataatatatgcttaactggcaggggagataccatgatcacaaaggtggttttcccagggcgaggcttatccattgccctctggatgtgctgacccctgcgatttccccaaatgtgggaaactcgactgcacaatttgtggtagtgggggactgtgttcgcgctttcccttgagaaaaaaaaaaaagaaagaaattataggccgggcacggtggctcacgcctgtaatcctagcactttcggaggccgaggcaggcggatcacgaggtcaagtgatcgagaccatcctggctaacacggtgaaaccccgtctctactaaaacacaaaaaattagccgggcgtggtggtgggcgcctgtggtcccagctacttgggaggctgaggcaggagaatgccgcgaacctgggaggcagagtttgcagtgagcggagatcgcactactgcactccagcctgggcgacagagcaagactccgtctcaaaaaaaaaaaaaaagaaagaaattataataatataataataactaccacttattggtcacttaatgtatacaaggcagtttattatcccatttaactgtctttattgaccctatgaaataagtactcttagtactcctattttatagatgaggaaacaaggcacaaggtgtaagtcacttacccaaccatcacatagctagtaagtaagtggcgaagctgggacttgaacctatgtctctccttcctcaggccctttttttattcaccaagagtacaggagcctaatcctgtaggcaagggaactggatcattttgactttagttcccttgccccaggtgtgggactagaggatgagggagcgggaaagcaaaccttgatattgggagtccacagcctcagtgcaagagttgagaaaatcaatactttgcaagctcagaaactgagaggccatagccttgtcttaatccgttcaggctgcaataacaaaatatcataaactagatggcttataaacaaccaaaatgtatttctcaccgttctggagactgagaagtccaaggtcaaggcagatttgatacctggcgaaggccagcttcctagagccttcttgctttgccctcacatggtggaagggggagctagctttcttccatctcttttaaaaggacccgaatcccattcatgagagctttgccttcatggcctaatcacctcccaaaggccctgcctcctaaaaccatcaccctaggagtcaggatttcaacagatgaattttgggaggacacaaacactcagagcataacgagcctggctttggccagggaatggttaactcaagttagagagaggaaaaaaaaaaaatctttggaaaactgggctgtcctggggtctgctttagtccctggcagtctggcaatggaaagccctacttgttgctttgacttgagaagccgtaatgagcagtgagccacaggcatagaccattcagtagacacaggtctttggccagccttgaacgacaactgctcagagggactgggaagaaagcccgcctaccacagggggcagggctgggagcagaagcaaagccccaggatgggagagtaaattgttataactatccctgcgaggaggtgctaacaaagttccaggttttctgcctacttcaatatttcccggttggcatagcatctactcttagtaggaacagagttctatttgcctaacagagtcaaattacctgtccagaggtacaaacactgctaggttctaagccttcagggtagtggagaggagtggagccttacctttagtttgttgtattttcaactctctgctgtcatcttacttttaggtctggcccctttgtgaaccaaattcttctaactgagtagcattgcgttagcagtcagaaaaaaaaaaaaaaaagatgcttttcaaatataggtagatgtctggacatcccttaggcaaggtggctctgtatgagcgtcactattaaagtgaaaggaaaggaaaagtctccccacccttgtttttttttcaaaaggtatagagtgcccgaaatactttagggatggcagctgttgagcatggaaacaagacttgtccctagagggaaggcaaggaaggcatggggaagagccttcctaactccacttagtgtaaaatcactctgtcctcttcccctgacctgagctggcttattccttggaagagataaagatctgggagtcaaaatgaccaccctgtgctgagcaggcttctttgaactccagctaaacggtaacagcacctaagataggatgttcccaccctcactccccacctcaaagtggaggtgaagagggagataagggaaagggagagaaaggtcccaggaaaggtctgctgtcaagagggaggacccgcagctggctgggagcattcacaggaagtaccaattttcacctccttttttccacagagctgttgcttatttgcctacgacggctgtgttcctcttgaggctgtaatgggcagactagctcagtgggtaacagtgtgagctttggatcccagccttgccacttactcccgcgtgaacttgtgtacaccacataacccatctgagcctcatcttcctcatctgttttgagggtaagaatggtgcctacctcatctacttgcagcaaagactaaattcgtttagtgcaaatgcagagccaggcccataataagtactgtcaataatgctaagatgccatgtttattgttcttgaagcatcacttcagaatctgtgcacagcat[137 bp omitted]cgaaaccccgtctctaataaaaattaaaaaattagctgggcatggtggcgcgcgcccgtagtcccagctactcaataggctgaggcatgataatcacttgaaccaaggaggcagaggttacagtgagccgagattgcaccactccagcctgggcgacagagtgaaactctatttaaaaaaaaaaaaaagccagtccagatgtgtttccatgtttcctatgattactataaacacacaaatgagctgggctcacagaacctcaatagaccttggatatgtatagctaatgatgagcagcgacaggaatcgagagttcgtacagaattttttggtttggttagcgtaacaacaggctttacagacaggctccatgtgcaagcactgcacacctctgtatgttctcagccttctgagaactgtcactgccaaatcttttccttcaccctccccaccctatctcacccccaggcaaggtgacactttcaaagttggcacggcaggcagcacatgccaggcctgtgacccaggcctcagcagctctgctcacttgcatggcaattgctttctacagtcaggcccagctgcactttgggtctccccaacccccacccccaatcaccacacaggaactggctgtttctcttttcttcgtccaagctgaatactaacctactgtggtttgcttgcttcccccattgtgatcgcaggctttctgagcagctagtcaaccctctagcctgccactgaatcggaaggcattcacactggaggggatcaaggggagcttgtaggcttgccttgctggcgggcagctgcctacacccactcgtaccaatgtccccgctgcagagcccgggtgcttcccagctgtacaaggacaactatttgggtcccggctatgccaagagaaacatgggtcatgtggttcacaggacagaaaggttcatttactccaatatgactggcatttttttttgtttgattattggatatttgccaaaagactgaagcctcctgccacaaccacctcccccacatatatgtcctcagatggtttgggaattggacagcttagtcatcaggtcctgtcctccacatccacagaagatacaagttgtttccagataacatgcagaaggttctgagctccttcctgtgtgctccagctcgaagactcttttcttttccctatgaattttttttccttttctttctctggtctttcctttttaatgcccttttaaaattaagtattctatcttttgagtgggtaacacatacacatgatacaaaatccaaaaggtgcaacgagtatatgctgaaaagtaaacctctctaacctttgtccttagccattcagctctcctgtgagtcagtactgttgttagcagtttacctgtatctttccaaagatggtctatgcaaagatccacataaacttgtacatttatgttctgtttttaggtcagcagcagcacactacatacactcttctgtgccctgttttttttccacctgaaaatgtatctcggctgggcacggtggctcacgcctgcaatcccagcactttgggaggccgaggcaggtggatcacttgaggtcaggagttcaagaccagtctggccaacatggtgaaaccctgtctctactaaaaatatgaaaattagctgagcgtggtggtgggcacctgtaattctagctactcaggaggctgaggcggaggaatcacttgaacctgggaggcagaggttgcagtgagccgagatcacaccattgcactccagcctgggtgataagagtgaaactgtctcaaaaaaaaaaatgtatcttggaaatgataccacatcaatccagataaagctgccacatatttttcatttatgacatagtattcaacggtatgatatactatttatttaactagtccctgattggtggacatttagattatttccagtcttctgctagtactaacaatgctgtaacaaatctccttgttacatacatttttcacgcacatgcaaatagatctgtaggataaaaaggggtccccaacccctggtccgtggcctgttaggaacctggctgggccacacagcgtgaagtgagtggccagcgagtgagcattatggcctgagccccgcctcctgtcagatcagcggcggcattagattctcatagcagtgcaaaccctattgtgagctgtgcgtgcaagggacctgggttgcacactccttatgagaatctaatgcctgatgatctgagatggaacagtttcatcccaaaaccattccccccaaccccttgtccgtggaaaaatggtcctcggcaaaaccagtccctggtgccaaaaaggttagggactgctgggctaaattcctagaatttttgctttggtcaaagggcatatgtgtcttacatcttttttttttttttttgagatggagtcgccaggctgaagtgcagtggcgcaatttcagctcactgcaacctccacctcctaggttcaagcgattctcctgcctcaccctcccgagtagctgggagtacaggcacacgccaccatgcccagctaatttttgtattttcagtagagacagggtt[139 bp omitted]cagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattctgatcaataagacagacttagtgaggccgaggaaatggcaggtttgaagtcctagaggaaggcaggagcaaggattctggccagcagcatggattacaggatctggaaagggtcttcaaggacattttgtttcagtctcctcatttgacatgtgagaaaactaaagtttagggagctaaatgacttgaccagggttatacagatagtaacaaagtcaggctgcagaatccagtgtgctcatcctgggagctgtgggtctgaactagacagctatgggatagttgcctgggtttgtgtagaaggacttaagttcaggttcttgtgacaagctgcgtgacatgtttcatttctctttactagtaagatacagtttggatgaatggccattccaatctagcgggttggtttgttcttcagcatacttgtctttcttacaagtttaaataataataacaatggtggttaattctttagcgcttgctctatgtcaaatacagttctaagcaacttacatgtattaaatcatttcattttgacagcagttcttaaagttggtgttattattattaccccattttacagatgaggaaattgaagctccagaaggtaaaggcacttgccaaccatcacagagctagtgagtggcaaagcagggggaccgagtccaaacagtctggcttcagggcccatgtgctttgtctcccaggcactctcagtgtcagcagcaggctgatggactcaggtttgagcccagagctgccttgtgccatggaaggtccaatcagtggctctcaaccctggctgcacatcagaatcagctggggagcttgtaaaaagtgctaatgtccaggcctcgcccccgttcagttaaattgcaatctctaggggtggatcccagtcactgagggtttttaaaagcttccgtggtcagcctaatgcagctaacggttgagatgtactgggatctaggcttgccattgctttgccctttgggagcaaccagcaccccatacttgcctttgtgttctggacacccacttagtaggacacttgtagaggcacttattcataccacagcacaggctcctgtctcagcctaaagaactcattcagtgtacatgctttggcagccacatccaccagtgatgtgcggtaacaagtctgtaaagggctaagagaatattttcagtcctgagcgtcagaagacagtggagcttagtggagtggagcttggctctgagtcaaacagacccagattcaagttgatgctttgtgtcatggtctgtgattttagagactggcgtttatcctctcaccaactccattttgtcatccatataatcaagctaatacgataatactacctctttcatgaggcttttgtgaggatta[132 bp omitted]tgaaaccccatctctactaagaaaaattagccaggcttggtggcagtcacctgtaatcccagctactcaagaggctgaggcaggagaatcgcttgaacctgggaggtggaggttgcagtaagccaagatcgtgccactgcacttcagcccggaagacagtgagactgtgtctccaacagaaaaaaaaaaaagaaaagaaaagaaagaggaaaaaaaagaaagaaagaagaaaaagaaagcactcagtgctaggccatgtctttatttcatgactatccacgtagcttatgtgagtaaacagctatatttgggaaaagctactagtgacactgatattgacaggaatttgatttgacatttaataagtgcctggtatgtacaatgaagagtgaaagatcctgaagagcttggatgactaggaaggccccgtgcctgctgactggcttgctggctgggagggagcataaagacacccagataactcatataaggtagagtgtgccgcagcagaggtctaaacgagaagctaagggaggccaggggcggtggctcatgcttgtaattccagcgctttgggaggctgaggcaggtggatcacttgaggttaggagttcgagaccagcctggccaacatggtgaaatcccatctctactaaaaatacaaaacagctggacatggtggcaggcacctatagtcccagctacttgggaggctgaggcaggagaatcacttgaacccgggaatggggaggttgtagtgagccgagatcgctccaaaaaaaaaaaaagctaagggagcacaagatatggagagagaaagccccaattcaaacagaagctggaaaacaattataaaataaccaaggaaatatgaatactaactgaactcaatatgtgatgatattaaggaattataaatttttaggtgtgataacggtattatacatatatttttgaggagcaattatagtttagataaacataattctaattaataatatgtaagtcagatgaattgaaatgatgtctcgtgggggtagagatgaaagaagattggccacgtatagctaattgttgaagttgggtgatggaactttgtgttcattttactggcctctctacttttatatatggttgagatttttcacaataaaaagttttaaaaagagggccgggcacagtggctcatgcctataatgccagcactttgggaggccaaggcaggcagatcacttgaggccaggatttcgagaccagcctggccaacatcgtgaaaccctgtctctactaaaaatacaaaaattagctgggcgtggtggcacacacctctaatcccagctacttggaggctggggcaggagaatcacttgaacctgggagacagaggttgcagtaagccaagatcgtgccactgcactccagcctcagtgacagagcgagattccataaaaa[136 bp omitted]tggtgaatccccatctctactaaaaatacaaaaaaaatagccggttgtctgtaatcccagctactcgggaggctgaggcagagaattgtttgaacccgggaggcagaggttgcagtgagccgagattgcaccactgcactccagcctgggcaacagagcgaaactccgtctcaaaaaataaaaataaaagagagaggtaaagttgaagaaaaggaaggaaacaagcagtacacaattgtggaatctggaaaattttcaggatgaggtggcatctgacttgggcatgggtgactagggagagttgatgtcgcagtttaaatctgaagggagtctgctggcagaatctcctcttccttgaggggcttcagtcttttttcttttaaggccctcactgattggaggaggcccactcacattatggacaggaatttgttttactcaaagtctactgatttaaatgtcaaactcatcttaaacatgcctttacagcaacatctagactagtgtttttcccaaatagctgggtactgtggcctaaccaagttgacatatgaaattaatcatcacagggtggcagtgggaaatgatactaggaaaaccggtaggggccaaattgtaaagggttttgaattctgttaaaattgtctttagtaaacttctttggaaaatttttcttctcaaaatgttttcgttagaaaattgggaattgttgaaggcttctgagcaaagcaatggtaacatctgatgagtttggaagggtacttggctgcaatgtggaggatgagttggagagggcagagactgaaggtcaaatgatgggtaaggaaactgacccttgcttaagagagatgatgtgaggtactgggagtagagctgaaaagtatccaaagcatagaatataatgcaggtagcagcaagagatcaggctgagcagtaggcagaggccaggtcatggagcacctggtaagccagattaaagagcctggagtttatcctgatgataatgggggacccactgaagagttgaagtcaagggagtaacctgattaaatcgctctgactgctagatggggaataagggcaggtagaccagctagtaacagttgtagtagtgtgggcaaaagatgatggtggcttggactagggtgagagtggaaagaaagaaaagtaaacaaatttgggacatgtttggagccactggaacttggttagtgatggattagatcagagaaaggtgagagacagagaaaacttaaaggtgactcaggttttgggcctgagcaagtaggttgatgacagtgccatttgctgacatgaggaaaactagaggacagtcaggattggagtggagcaaaatcaagagttctgattaggacatataaagtttcagatgttcagtagacttctgagtagcaatgtcaagtagctagttgattacatgatcctgtggctcagaggagagatacagatagaaatttggaaatcatcaagcagaggagaacagaaagaaggccagtgcagttgaagggttttgtgaccctttatcttgggtcacaaaagagtgacccaagataaagttgaaaaggtgggagggtcaggcatggtggtgcatgcctgtggtcccagctactaggaaggctgaggaaggaggatcacttgagcccaagagttctggactgtagagcactaagctaatcagatgtccacattaagttcagcatcactatggtgacctctcgggagcgggggaccaccaggttgccaaaggaggggtgaaccggcccaggttggaaacagcagatcaaaactcctgtgctgatcagtagtgggattccacctgtgaatagcctgtgttgcccactccagcttgggcaacatagtgacaccacatctctgttaaaaaaaaaaaaaaattttgagacagagtccgctgcgacgtccaggttggagtggaatggcgtgatctcggctcacttcttcctgggttcaagccatctctgcttcctgggttcaagccattctcgtgcttcagcctcccgagtagctgggactacaggcatgcgccaccacgcctggctaatttttgtatttttagtagaaatggggtttcaccatattggccaggctggtctcaaactcccaacctcaagttatctgcccacctcggcctcccaaaatgctgggattacaggcgtgagccactgcacccaacttaaaaaatatttttttaaaaaaagaaaaaaatcggtgggcagagcagatcatataggaccttgtagcctacgagcatgctggaaccacttcctactggctcaggagaactgactgttaaatttcaggaaatttgggagctggtcgacttcgcatttggcagcctgaaatcagccatagtgggagtactgatgctgttgaaattggtaaatgctacaattcagcccttttttattttcccccagagaaccagttgttaaactttgccaccatattagtactatggcttgtaggctccagtaagaaatttagattttattcttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcataattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctaggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagcatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccacatttcttggaggctttgctcatttctttttattcttttttctctaaacttcccttctcgcttcatttcattcatttcatcttccattggtgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagactgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtcgtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctcccgctttgttttctttttcatctcagtttttgaggataagaatgctttgttttaaaagggatcatctgtgtctttttaaaagcttactgaattttcctggtgtgaattatttgcacgtactcatttttgtggttgatttggattttacagtgattaagattttacagtacctgctccaccgggcccagatcctgcttcccagatcttcctgggaagcaccaagaaatttagattttattctaagtgtgatgtaaagtcattaaaatgttttaagcag[142 bp omitted]aaaccccgtctgtactaacatacaaaaaaattagccaggcctggtggtgcacacctgtaatcccagctactcaggaagctgaggcaggagaatcgcttgaacccgggagacggaggttgcaatgagccgagattgcgccgctgcactccagcctgggtgacagagcgagactccatctcaaaaaataataataataatacatcactgtacaagaatggactcccagtgggagaaggcaagatcgctaaggaaactgctgcaacaatccacatgcgcagtggtgccttggcagtgcaggtaagagttcagtcaagaaatttggaagattgttaacatcctaagactggatatagatggaccttgatttatcacaagttgattataattgacctgttatgtaattcgtgttacttagtgtctttttgttttagttgtggggagcaccagattacagaatgattaccttgactcatgacccagggctctttacaattcttaccagaaactggcagatgataaatcagtcatcttatttggtagcaaaataaggaggttactttcctgcatgaacataaatttcctcttttcaatatttcagtcttacattagcaggaggaacttgaagtcttgtgattaggcagattctttgtaagggaaaaggcagcttactatccttttggtaacagttctttactgatagggtaagaaggaaaggaggttgagtccgaacaatgctaaaggaaacactttaaagtaagacatccactgaagacccctagccattttgcctactgtaaaatagaaccatctacaatgtcttgtgaagagagaaatgaaatgaattttgatatttgttttctgcaaagattctacattacattgtgtaagtcttgacccacgatttttataactcatgcataaaattatgtgcaaatgctttaaaaattccagcccactcttatactgagcattttatgtactcattcagcaaaccattcattgagcaccagtcatgtgtcagctgctgcttaaggcactagagatacgaaaattaaaaagacccagtcctcacagagttcacagaacactaggaaaaatagacatgtaaattggacatgattacagtacaattgtgaaagaggtctctttgaaagagttgtctgtatttatttaccatctccagtctttcttttcccattctctctctttttttttttttttttttttgagacagaatctcactctgtcacccaggctggagtgcagtggcacaatcttggctcactgcaacctccacctcccaggttcaagcgattctcatgcctcagcctcccgagtggccgggattacaggcatctgccaccatgcccggctaatttttgtatttttagcagagacagggttttgccatgttggcaaggctggtttcgaactcctgacctcaggtgatctacttcccttggcttcccaaagtgctagaattaacaggtgtgagccaccgcgcccagcccccattctctattctctctctctctctcttttttttttttttttttgagacagagtcttactctgttgcccaggctggagtgcagtggcacaatctcagctcactgcaacctccgcctcccgggttcaagcaattctcctgcctcagcctcccaagtagctgggattacaaccaggctgggagattcagcttgtccatttcatgttctgtttctcacaatcatctgtgtttgcttgtcactgcactttaaagagaaggcataactcaaaagtttcacccttcaacttgatggagaattattttttatttatttatttatttatttatttatttttatttttttgaaacagggtttttctctgttgcccaggctggattgccgtggtgcaatctcggctcactgcagcctcaacttcctgggctcggtcgatcctcctgcctcaggatctactccctcctgagtagctgggactacaggtacatgccatcatgcccggctaatttttttttcttttgtagagatgaggtttcgtcatgttgcccaggctggtcttggactcctgggatcaagcgatctgccagcctcagcctcccaaagtgctggaattacaggcatgagccactgcacccagccattctatatttttaaagcatagaatattgattctttgagctggattaatgaggaaagatataacaatcattaatataaaataaagaattgtgaaacctcattaatttgcatgccactaacctaaaattgtaataacccagggcttagtaagcaaattagtcatataaacagcataactatagggatatttaaactgtttaccaaaagaagctgcttttaaagcctgctgaagtacttatttattactaataatgtctaatattattgacacttataatgttgctggcactcttcattgtcttatttaatttccatagcaactctaagagctaggtatta[132 bp omitted]aaaccccatctctactaaaaatacaaaaaaagccaggcatggtggcaggcacctgtaatcccagctacttgggaggctgaggcaggagaatcacttgaacccaggaggcggaagttgcagtgagccaagatcgtggcattgcactccagcctgggcaaaaagagtgaaactgtgtctcaaaaaaaaaa[131 bp omitted]gccaacatggcaaaaccctgtctctacgaaaaatacaaaaattagccaggcgatgtggcacgtgcctgtaatcccagctactcaggaggttgaggcacaagaatcgcttgaaactgggaggcagaggttgcagtgagccaagatcatgccactgcactgcagcagcctgggtgacagagtaagaccctgtctccaaaaaaaaaaaaaaaaaaaaaaaaaaaggaacttgcttaagatcaaaaatagctaatgagtagaagagacaagggttccaatccaggtctgtgtgatgctgaagcccacaggcagaagattcgcactctacctaggcttccacagatcactcaaccatgcatgaaagtaaggcctgaaaagtgtctctactaggttgcccttcattaatctagttccagtcatgtataataaaatggagtgtctttccaaaatttcataatttagatttcactcatttaggccgacttcccccctatacatacccactagttggaattagttgccttttactatatgctgtattgaatgtccttatagttgggggtcatgagaaaagctaaagtctaacttggacaagatgacgactggcattgccagggttgtgcagcaacagtagtggggtggggtgtcctgcaaggacatgagttaggtggctgttaggggcagcataagttgtagtgtaaagccttggagcctagatgccaaggtcgcagagtcaccaggaggcaggatcctggagtacagattgcagtggcccagtaggcacagcatctggcctctaggtctgcctctgctatgcaccagctgggggctttggttaagttgctctgcttctccaggtcataggtttttgtttgtgaaacgaataattggaagggaagatcttagggtccatttcagattggggtctctggtttagggatctgcgttatcagagtctaaagtaatcaagtccttggagatctagtaatcagaaggagagcaagaaagagccagctttcattgtcaggggcaacaaagaggtggctcatgcccataatcccagcactttgggaggccgaggcaggaggatcacctgaggtcaagagtttgaggccagcctggccaacatggtgaaaccccacctctactaaaagtacaaaaattagctgggtgtggtggcatgcacctgcaatcccagctactcgggaggctgaggcaggagaattgcttgaatctgggaggcagaggttgcagtgagccgagatcaaccactgctctctagcctgagtgacagagtgggactccatctcaaaaaaaaaaaaaaaaaaaaaaaaaaagaaagtccagaaagcctggtttgaatcagtaaaatcgagttttcacactgcttcactgattgtaattcattcttctacagatttttaaggagggtggaagagagaaaagctaagtaaaatgtggtcctagccatcacaggtctcatagtatcctgagggaaagagacaggaaacaactaactggaatataaaacagaataaaatgtgttcattacctgctgtatgaccttggtcaaatcacttaacctgtccctgagcctcagtttcctcaactttaacagacacataagcagtcaataaatgtcagcagctatgcatcagtagtggcaatagtaatatggactacatgtgtaatattttgtactatgccattacatcttagtaaaatagaaccatctacaatgtcttgtgaagagagaaatgaaatgaattttgatatttgttttctgcaaagattctacattacattgtataagtcttgacctaccgtttttataactcatgcataaaattatgtgaaaatgctttaaaaattccagcccactcttatactgggcattttatgtactcattcagcaagccattcattgagcaccagtcatgtgtcagctgctgcttaaggcactagagatacagaaattaaaaagacccagtcctcagagttcacagaacactaggaaaaacagacatgtaaattggacatgattacagtacaattgtgaaagaggcctctttgaaagagttgtctatattcaccatctccaatctttctcttcccattctctttttttttgagacagagtctcactctgttgcccaggctggagtgcagtggcgtgatctcagctcactgcaacctccacctcccgggttcaagtgattctcatgactcagcttcctgagtagctgggattacaggcacccaccaccatgcccagctcatttttgtatttttagcagagacagggttttgccatgttggccaggctggtctctaactcctgacctcaggtgatccacttgccttggcctcccaaagtgctagaattacaggcgtgagccaccatgcccagcccgattctctcttgagtccattccagtcagacttttgctccaccatccaataaacttctcttttattttttgagacatggactcactctatcgcccaggctggagtacagtggcacaatcatggttcactgcagcctcaacctcatgggctcaagcaaccctcccacctcagcccccccaagtaactgggactacaggtgtgcaccaccacacccagctaatttttatattttttgcagagataggggtcccactgtgttgcccaggctggtcttgaactcctgggctcaagcaatcctccccctatggcctcccaaagtgctgggattgcacatgtgagccactgcacccagccaaaacttctctttttatgataaccagtgacctccatgtgtttagatccaatggtcacttctcagtcttcatcttactgggccctcagcagctcaccactcctccttgacataccaccttcacttggcttcctggacaccacactttccttttccttcttcaccaactgctccttctcagtcttctttgtggggtctaatgtggaagtatccccaggctcaagccctaagtgatctcatctggtctcctggctttaaataccacccatgtactgatcactccctaattatgtctccggccctgacctctcccctgaactccagactcatgtagccaactctccatctccatttgaatggctaacaagcattgcgcagttgaactcctgatgttttcacccaccctcaaaaaacaaaaacaaaaagccaacctgcttctcccatagcgtcctccatctcagttcatggcacttctgtctatcccgtcacttaggccagaaactttagagccatccttgactctcctctcacaccctcatccagtccatcagccaatcctgttgactctaccttcagaatatatcgagtctgatcactgctcaccactccaccactagcatcccagtccaagctaccgtcatctcttgcctaaattactctagtaatctcctaaccagtctccatcctacttttccctccattcttgagtctttttcaacacagcagccagtgatcatgtgaaaatataaattaggtcatgccattcttctattcataaccccccccagtgaccagtcttctcagtaaaagccaaaattcttactgtgtgccctaccagccttatacaacctagccaccatttacttttgtgaagtcatatcccattactctctattttgttcattccattaccaccacattggcctcctcattgcctctgtaacaccccggacatgctcctgtcccagggcctttgaagatatctgtacaacttgcttcctcacttccttcagatctccaaaaagccatcttcttggtgaggtcttctctgattaccctaataaaaacttcagcatcctccagacactccttatgttccccctgcttttattttatccagagcactcacctcctcttagtatttggtgtaatttacttatttattttctttctttgtcttgtcttcccctgcaattagactttcagctttataggaacagggacttttgtctgtttggttcactaatgtatcctgagtgtcgggcatatagtaagtatcaataaatatgcaaataaatgaatagtctttagaggagataatgggagtataaaaaagagctaaggagtgcagtcagtatgattggggtgagtgatgcttttcatgttggaaaagttgtcatgaagggccttacatgtcattctaaggagcttagattttatcctataggcggtaaaatgtcagtaaagtagtcagtggtctgaattggaattttagaaatgcgttctggctgtagtataaagaatgaggccgggcacggtggctcatacctgtaatctcagcactttgggaggccgaggcaggtggatcacctgaggtcaggagttcaagaccagcctgcccaacacagggaaaccccatctctactaaaaatacaaaaattaggcaggtgcgatggcatgcacctgtaatcccagctacttgggaggctgaggcaggagaattgcttgaacccaggag[136 bp omitted]agcactatgggaggccaaggtgggaggatcacgtgagcccagaaattcaagaccagcctgggcaacatagggaaaccctgtctctacaaaaaatacaaaaattagcagggcatggtggcacatgccagtagtcccagctaccagggaggctaaggtgggaggatcacctgagcccaggaggttgaggctgcagtgagccgttattgcaccattgcactccagcctgggtaacagagcgagactctgtctcaaaaaaagaaagaaaagaaaagaaaagaaaagaattgaaaaggacaagagtgggtccaagaggccagtaacagactgctacagtaatgcacacatgagatggtggtagcctgaattatgggagtgccagtggggatggaaaggaggattgcttggatagggcagtaagggtgggcgaaatgaaggaattccaggtttctggcttggggtagcttgttaaagacttgggccattcatcactgagataagaaatacagaagaaagaataaatctgacactgtcaagaagaaaggcaacgatagattctaggtgtgtcgagttttgagtacttgtgtactatccaggtagagctgcccagtaggcagttaggtgcttggttttggaggtcagtgggaggtcagagccaaagataaagatttgggagccatctgcctgtaggaggtgtttaaagcaaaagctatggtagaatttcctagaaaaggtatataaattgaggaggaccaaaagagttcctggttatcagtgccaaatattgccccctaagaaatccagtaataatatagccaaaaagagccactggatttggaaaccaggaggtcgacaatggaatacatttcatttattcaaatgtttattaaatatctactatgtgttaagaatactaaggatacagaagtcaataaaacagatcaaaaaatccctccttacatgtagctgaaattctagttgcagagaaggagcagataaataaaggaaataaataagtaaattattccaaatattaaaaggcagtgaatgctctgaaggttagataagctgcctagggtcacagggccaagtaagtgaagaaactaggactagaaacgaacctgctcaactccagagttgtgctcttcttactgttgtaccacacctcctctcccacatcgataatcttggttccattgccacagaatgccatatagccccaactaaacatttcagaaacaaaccaaagtatgtgtatagcttaatctaaactcaacaccatttctgaaagccagctctgaggggacatccccttcacagtggacaggtagtaccagttttatatgtagatggtatattgaaaagtcatttcatctgatcgtaaaattatttttctaagaggatggctgggtgcagtggctcacgcctgtaatcctagcactttgggaggccaaggcaggtggatcacttgaggccaggagtttcagaccagcctggccaacatcgtgaaaccccatctctactaaaaatataaaaattagccaggtgtggtggtgtgcacctgtagtcctagatactcaggaggctgtgacaggagaatcgcttgaacccgggaggtggaggctgcagtgagccgagatcatgccactgcacaccagcctgggcaacagagtgtgagactctgtcgcaaaaaaaataataatattaaaggagaaaacgttcctttcagagatggagcattttggtaataatagggttccgtcaggatggctctgaaggtggtgatgatgtccacggggtggccaaaatggtataaaggtgaggatcactgaagccgaaggccagaaactggtcatgggctgggtcgtctttatagatgccaaagttacctaagatgacggcgaggctaggagagggtgagccaccaggtatcacagtcttcaatgaacgtggaagagtggccagattagtagataatagcaggccaaggagtatggttcagtgacatcagccccagctaagtgcttctgtcgtgagagtgaaggaggaagggtttgggaacagcaacagagagcgagaagaatgccaccatcacaatgctccctaccctgtcacatctgtgaggtggagaaatgaacagcctccgcttgggagcttcacaggggaaggaccagtaaagacaaggaaacagaatactttaaaaaggctaagggcatgggattatgtttatcatgtccagaaggcacaggttgggagggaatgtaagtatgaaattgaatctgtcccaaatgtctgcttccttccaggcaaaataaacgacaaatatatggacagggtatcatgattgtattgcacgttaatatctgttctaagcccacagaacaagaagaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtcatgcccttcaatcactgtcattcctctcccaacccacactgagccagctttccttttgccatctttcctgattccaaaaagagttaccatttgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaattttttggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacactcatacatagagagagattttcggtatgttgcaagtattttttccgattaaatttattttccaaagaaaaaatgatgtgttggtcatttattgctagtctgagttataaaactatggttaaatacatattggccaaatctgtaaactctcaaagccttatcctatttaagtataccaaaataattcacttttccaactgctgcggcattctgttttatggagaatggcagttaacacacacacacatggaaatctcatctgtagctcaatctgttagagtttggagggtggcagattctttacccaaagtgaatagttcatgtttattactctttattttccttgaaacagacaacttttcaaacagttctgaaagctgcaaaaatattttttacttttttaactataaaatcctaacctcacattatttcatgataatatcttgtgtattcttccacaagtaattttttttttaatttgaaaaaaaaaattgtcacccaggctggagtccaatggcgtgatctcagctcactggaacctcctcccgggttcgagcagttctccagcttcagcctcccgagtagctgggattacaggcgcctgccaccatgcctggctaatttttgtatttgtagtagagacagggtttcaccatgttggccaggctggtctcgaactcctgaccttaggtgatctgcccacctctgcctcccaaagtgctgggattacaggtgtgagccaccacaccctgcccttccacaagtattattaaatagatagctaaactcttgcagttgtcatgcacagaaatgttttctgagctgcagttttgattttttcttcattaaattaagtggggaaaataatacgcctgatttttctaatttcagaagaactctaaaactcttgttctgtttctaaaataaacttccagctaatttcattttctttggattatgaagagagagttctgcctttctgctttatggctgacagtgagcaccacactggactaagtacttgagaaggattataaagatgtgtgatgcaatgttgactcaggaggaatttatggtcttgaggaacaaatcatacctacatatatgaaatgactatgattacaaagcaaatacaagcaaaggcatgataatgtagtatgaactgttcataagattgccaagaagctctatacaaacttagtgaataaaaaactaaagggatcatcacatgggagagagactagtgatcaacagggatttggggaggttgtgagtctttttttttttttttttttgaaacagagtctcgttctgttgcccagcctggagtgcagagatgcaatcttggcttactgcaacctccacctcctggttcaagtgattctcgtgcctcagcctcctgagtggctgggactacaggcgcctgccaccatgcccagctaatgtttgtattttcttggtagagacggggtttcaccatgttggccaggctggtcttgaactcgtgacctcaggtgatccacctgcctcagcctcccaaagtgctgggattacaggcatgacccaccgcacccagccatgagtcttgaactaagttttgaaagaagttaagggatatgtattggtcacgaataggaaggcattgcaggttaaaggcagggcattgcagcatcacagagatggaagcaagcaaaagtgggtcagagcaagaaaagtggctttgtgcatttattcaataactgctaggcactacagacacagtggcacaaaaggcagataaggtccttgccttcaaggagcttacactctagtgagagtggcagtcaataaacaagtaaactaataaataatttaggtaatcatggactgtgatgttatgaaggtgcttatatagagggtgctttattagagaattatgtggaggtaaggggaatattttatttttggtttttgttttgagacaaggtctcgctctgtcgcctaggctggagtgcagtggcgcgatttcagcttactgcaacctctgtctccccggctgaagtcacaggggaatattttaaatcagggagccagagaaggccactctgacaggtgacatttgagatgagaccagaaggatgagaatgagccaactatgcaaagaaccagggagggctggtcaaagtgcagtggtgtttacaagtaattgaccacaatcagctacagatttctttgttccttcccactcccact[140 bp omitted]ggtgaaaccccgtctctactaaaaacgcaaaaattagctgggcctggtagcacacacctgtaatcccagctactcaggaggctgaggcaggagaatcccttgaacccgggaggcggaggttgcagtgagccgagattgcaccactgcactccagcctgggtgacagagcgagactccgtcaaaaaaaagaaagaaaggacagaaaggaaagaaagagagagagagaaagaaaggaaagaaaggaaagaaagaaaaaaaaggaaagaaaggaaaagagaaagaaagaaagaaagaaagaaagaaagaaagaaagaaagaaagaaagaaaaaggaagaaagaaagaaagaaagaaagaaagaaagaaagaaagaaagaaagaaagaaagaaagaaaggaaggaaagaaagaaagaaagaaagaaagaagagaaagaaaggagagaaagaacgagggagaagagcattcctggaaagaagagaaagaaagaaaggagagaaagaacgagggagaagagcattcctggcagagggaagaacaagcacagaagtgtggcagtgggaaagccttggtgaacagaaaggaggcgagggtagccagagtgtggtgagagagtgggatgagatgagattggagagagacagccaggtcttatgtggccatgtgggccagaacaagaagttaaattttattctaaatgctgtggggaggcattgaaggtttttaagcagaaaagcgatataatctgactttgatttttataagattactcagttgctgtgtggagaatggattggagggaagcaaggctgtgagtgagaagaccagttaagaagcgatttcggaagtccaagcaagaaaggatggcttggactagaatggtggcaataaagatggagaggaatgaatgagttcaagatgtattttgaaggtggactcagcatgatttgctgaaggattgaatatagggagttaaagaaaggagtcaagggtggcacctaggtttttggtttttgtttttctgagacaggatatcactctgctcccccaggctggagtgcagtggcgcagtggcgcaatctcggctcactgcaacttccgcctcccaggttcaagcaatcctcccacctcagcctcccaagtagctgggattataggcatgcaccaccacgcccagctaatttttgtattttttgtggacatgggatttcac[131 bp omitted]tagatgatcttgccatttgctgatgtgaggaagactgaggagggacagagttttggtggggaggaattcaaagttctgttttggacatgttaaattcaaaatgcccatgagacatgcaagtagagaagtagacagtgggctggagcacatgctgtctgtgtaattgtccaaaccagtcgtggtaagcagaataatggccctcaccaaagatgtccacaccttaacccccagaacctgtgagtatgttacctttcatgacaaaagagactttgcagatgtgattactgttacagacattgagatggagggattctcctggattcattgggtgggcccctaatcacaatccttaaaatcacaagtggggccaggcacggtggctcacggctataatcccagcactttgggcggccaaggcgggtggatcatttgaggtcaggggtttgagaccagcctggccaacatggtgaaaccccacctctactaaaaatacaaaaattagccgggtgtggtggcacacacctgtaattccagctactcaggaggctgaggcaggagcatcgcttgaacctgggaggtggaggttgcagtgagccaagatcacaccactacaatccagcctgggtgacagagtgagactttgtctcaaaaaaaagaaaaaaaaaaaatcacaagtggaagaggaagacagaagaatgggtcagggagatgcaaggatggaagaagaggcaggagaaatgaggcctgagaagaactggactcgccactgctggctttgaagacaaaggtttccaggtgccaagaaatgggtatggcctctagaagctgagcatgaccctcagctgacagccagcaaggaaacaaaggacttcagccctacagtcacaatgaactgaactcagccaagaacctgaataagcaagctaaccaattcacctctggagcctccagagaggcatgcaggcctgccgacacttcgattttggcccagtgagacccacgtcagacttgtgactacagaactacaagctaataaatttgtgttgtttaagccaatgcatttgtggtaatttgttatagcagccataggaaactagtatatcagaactttattgataattatttcaggataatagggacaagtctagagtgtggggaagagtgatgactggagataggaatttgggtgtcatcagcagatagatggcaagggactgagtaagagcagcaaaggagtggatgggaagaaacttctgggggagttggaagcaacaaaaactgacactcaggatggtggccaaagaaaggcctcaagggacgtgaggccgggcatggtgactcatgcctataatccccgcactttgggaggccgaggtgggtgaatctcttgaggtcaggagtttgagaccagcctggccaacatagtgaaaccccatctctacaaaaatacaaaaattacctgggtgtggtggcgggcacatgtaatcccagatacttgggagggtgaggcaggagaattgcttcagcccgggaggcggaggttgccgtgagttgagatcacaccactgcactccagcctgggcaacagagcaagactctgtctcaaaaaaaaaaaaaaaaagatgggacttgaaccaggcatgctgacttgaagccctagtacattctattgtgatgcaggtgcctctaatctaatcacagacaatgaggaggaaaaaaaacaagtataacaacaataggagactggagaagggatagacacggggaaagtcggggcaagttggggcaagtcgggaaaagtcgtgtactagcagaaagcaaaaataaattcttcagtcattcgtatctctcccttttgttgtcattgctagccaaaaataaaagtaatatccaaactaactgatatgatattcaggtccatttgacagctgttacttaggaactgtctaaaatattccaatggggccaggcacagtggctcatgcctgtaatctcagcactttgggaggccaaggtgggaggactgcttgagtccaaagagttcaagacaagcttgggcaacatagggagatcctgtctctacaaaaaaatttaagaattagccagaggtggtggcaggtgcctgtggtcccagctaatcgagaggctgaggtgggagggtcacttgagcccaggaggtcaaggatgtagtgacagtgagccatgatcacgccactgcactccagcctgggcgacagagtgaaaccttatctcaaaaataaatataaataaataaataaaatattacaataggatgatggaaacgaggggggtgtgtttgacatacagcaaagcacatatagctatagtagtcatcagaagataaataccacatattagatcctgaaataaatatttttgctcacatctctaaaaggaaacttgaaataaaatttcatgtactcattatgtttactttggaattagaagttatacatctttatcaaagatgaatctctgctccattttcaataagctcacctggggatcctgattgttataccaagctgcctgattttatatatatcaaattacatttaattatatagatgcgatatgtaatttttcccataaagttatttagtcttactcagactaaagttggagatccataaagcaaaatgtatatgtgcagggggtgttttgtgtaaatttaggggtataagtacaattttgttatatgactacattgcttagtagggaggtctcgtcttcatataaccatcacttgaataatgtacattttaccctgcacaggtttagaagctagtcacagcttataaaatttattaaaatatgtcaaatatttctaagttaaatttttctgagttaaattatttatatgcaattgggccatatgcagtggctcatgcctgtaatcccagcactttggaaggccgaggctggtggatcacttgaggtcaggagttcaagaccagcccagccaagatggtgaaaccccatctctactaaaaatacaaaaattagccaggcatggtggtgtgcgcctgtaatcccagctacctgggaggctgaggcaggagaatcgcttgaactcgggaggtggaggttgcagtgagccaagatcacaccactgtactccaggttgggcaacagagcaagacattatctcaaaaaaaatttatatacaattgcatttaaatggtaactaaccacccccattgggcaacatagggagaccctgtctctacaaaaaaatttgaaaattagccaggggtggtggcaggcacctgtggtcccagctaatcgagaggctgaggtgggagggtcacttgagcccaggaggtcaaggttgcagtgcctgatgtggaggaactggaactcttgtatcccgctgttgagaatgtaaaatggtataatcactctgggaaaaaacttgggcaggtcctcaaatggttcaacatagagttaacatgtgacccagtaattccactcctaggtgacaaccccagaaataaaaacatacgtccacacagaaacttgtataggaaagtttatagcagtgtcattcataataggcaaaaagtggaaatgagccaatgtccatcaaatgatgaataaacaaaatgtgggccaggcatggtggctcatgcctgtaatcccagcactttgggaggccaaggcgggtggatcacctgaggtccaggagtttgagaccagcctgaccaacatggtgaaaccctgtctctactaaaaatacaaaaattagccaggcatggtggtgcatgcctgtaatcccagctacttgggcagctgaggtaggagaatcgcttgaacccaggaggcagagttcacagtgagccaagattgtgccgttgcactccagcctgggcaacaagagcgaaactccatctcaaaaaaaaaaaaaaaaaaaaaaaaagtggcatatctgtacaatggaatactacttagcaacagaaagtaaataactattgatacgcacaacatgaatgaatctcaaagagtaacatgccaagtgagagaagctagaccccagaaagaagagtgcataatatatgatctcatttatacaaaattctaggaaatgcaaaattctaggaaactaatctatagtgacagaaagcagatcaaagtttgcttggggatggagagattacaaaggggcacaagaaaattttgtgtggtaatggatatgttcatgatcttaattgtgatggcttcacatgtgtatacatgtgaaaaaacttagcaaattgtgcactataaatatgtacagtcttattgtctgacaattacacctcaataagactgttgttttaagcagttacccatgggctggaatccaccaactgttgttttgttttgttttgttttgtttgagacagagtctcactctgtcacccatgctgtagtgcagcggtgcaatcacggctcaatgcaacctccacttccctggctcaggtgaccctcctgcctcagactcctgagtagctgtgactacaggcatgcaccaccatgcccagctaattgtttaattttttcgtagagatggggtttcaccctgttgccctggctggtcttaaactctgggctcacgatatcctcctgctttagcctcccaaagtgctgggattataggtgtgagccactatgcccagctgtatttttcttaaaattaataaaatctaacacatattaaatgctgttctatgcacatattatctcatttgcatgtgcctacagtcctctgaggtataggcactactatcattctcattttacacctgaagaaattgcagtttggagaggtaaagcaatttacccaagacctgacagctagcgaatggcagagccagaatttaaacttaagcaacctggttgcagggcccaccctcttaaccactgggctaaattacctttctcttcctatttgctccagattcccagacccagacgctcagatccactcactcttatagatacaaaaggatagagccacagaatcttagaattggaaagggtgtagaactctcttccagaccaacccagcgatctcccccatagcatccctaacaagtggctattctgcctcaacttttagccttcccagtaacaaaaagttcaccccatcgtatggcaacccattctacctttaagtatcgcatattttacaaactaatgtctttttgagctgaagtctaccttcatgaaacttctaccagcgggtttaattccatatagaatgtttaatttatgaagacagttatgatgtccttctttcacccaaagctctttcccagttaaatatctctcattcattcagccatttctcataatacatgatttatagacacttcactttcctgattgccttgtttgaatatgttccagtttgttaatgtcctcttaaatgtagcatccagaattaaatgtaaaactctatgggctggccaacagaaacccaagtggaactgaaagtccctctgatctggtcactaccattctcttagtgcaactcaagactcgttagtattttttggcattgtcaacccacagtgaactaggacctagttctctttttcacacatgctaccattaagctctatctcctcatccttaaatgtcttgcactaaatagggcattaaaaccctttattgcaatgcttcccattttataagcctgggtttattctggactttagcccttatgactcaattcctagaggtttgtgatattctttgggctttgtccttggaagcatagtcctccttctgtcatctatacatgcacttttaagatctgagctcatcagagaataatctataaggacactgtagtttattagaaatctctccctttttaatttatcattggaacttttccaaattctacagttctgaattttcaactggatccctctcccttttaagctatctttctcttttggtgttaggccagatcatacttatcttttctctgatccttttgaagtctaccttacacatacacatacatacaccgcacacacacacacacacacacacacacacacacacacacacacacgttaattaacctatgtgaccatgcccagcaattttttttttttttttttagtttttttgcttaacagatatccagatgacaggatcactttccccaagattcttgtcactttcactttgctaaccaaatcttccttatttattatcaggattaagcccagcttagcaatttacctcattgcttctttattcttttgagaactgtaattacactgtatcagcaagagagccaagaatctatcagatgttttcttaaatttaagatggtcttaaaaataagaaaaaagaatgtatcagatatgttgctatcagaataacttccagcagatattcagatgttctatgtctctgatcaccctttcctgttcgtctatgtgacagttttatgaaatgccattcatacttttatttattttatttattttttatttttatttttattttgagatggagtctcgctctgtcacccaggctggagtgcagcggcacgatgtgggttcactgcaacctctgcctcccgggttcaagcgattctcctgcctcagcctcctgagtagctaggattacaggcctgagtcaccgcacctggctgatttttgtatttttagtagagacggggttttaccatgttggccaggctgatctcaaactcctgaccgcaggtgatccacctgcctcggcctcccaaagtgctgggattataggcgtgagccaccgcgcccggccccattcatacttttaatctgagaagtctcttgtatacttctacaactataatcactttcatttctccgtttcattctcactgaatgcttttcaccctccagccaatgaattactagttataccttcttgacatattactgctctcttcttctgtatggtatctctgaatcaagttttccagatgccagccagaagttccaccctcccaagtctaaacaatacctataaaattgcattttcctgagtgtattaaaattttacattcccggccagtcgctgcggctcatgcctgtaatcccagcactttgggaggccaaagcaggcagatcacctgaggtcaggagtttgagagcagcctggccaacatggtaataacctgtctctactaaaaatacaaaaattagccaggcgtggtggtggcgtgcctgtaatcccagctactcaggaggctgaggctgaagaaccgcttgaacctaggaggtggaggttgcagtgagcggagatcgcgccattgcactccagcctgggcgacaagagcaaaactctgtctcaaaaaaaaaaaaattacattccctttattacccatattctgggtgttggtacatagatatctgaggccttaaaagtgtcatttctgactctcttccttgtttttccttgagaattactaggcattgccttagctttagttcctcttaattagacttatattttacatagcttccagaaacacaataattactaacacagcactatgtctcaatggaggaattagttttgattaactgaccagccatatatcattatcaacatcatcatcatcatcatcatcatcatcattaatattcttctcggctgggtgcagtggctcatacctgtaatcccagcaatttggaaggctaaggtgggaggatcacttgagcctaggagtttgaggctgcagtgagctatgatcgtgccgctgcactccagcctgggtgacagaatgagactctattttctattttcctggatgcttgctccttgtttctttttccttcttttttaaaaagtttttaaactttcagacttttttaaatgttgcaaaaatagtacaaaaatgtccttatatcctttattcaacttctctaaatcttacataaccaccataaccaagaatagtattggtaatctacagatattcaaacctcaccaatataaccaatgtcctttttctggtacaggagccggttgagtgtcatatattacattcagttgtcaagtatctttagtctcctttaatctgtgacagttccttagtctctttgtctttcatgatcttaacagtttcgagaatatctgactccttaaaatacacgcggtgataggtgactacgggagctccagctcaccgtggatttagcaaaataccaagtgatgacaagaagttgcttttaaatgacccatcttgtatttcatcgtcaataaaaccacacttagttacccaaagactgagaagggaaaaattctatgtaattatttgatcatctttttttgtggagagaaaaaaaactgacaaaacaatgagctctggaatagaatacagtagaggcatcatgctcaaagagagtagcagatgtggccagggaaaggtcacatgtagaaaagggatacacaagtgatggcgaggtgtatcgaggaataattaacagttgaataaaaatgcattaatcagaatgtcaagagttcaaactagaaagattttgaattttaaatgcattataaataaaatccacctctctccaaataaagccctctgtagaattttgctttagctcttgtttctctcaccagaatagagaagcgagtatcacctttggaggatatactctaccattctctgaaactgtttttttgcattcagctacctcgctattataatcagctgagaaacaccatagcctttcactaacacaggtcaaagatttctcccaggatcaacaaagctagattcaaaattgctcctttgaacacatgcaatttgtgtgcatcagtttcgatcgctggggttcttgaggagactaacaaattgcaaagtgtactttcagaggaagggcctaaccatcctggggggtcctagaattgggtcctttcacaggcagatctggagaagataggagagggcaggaaaggaaagtgaaggatatgaacactatgtgttcagtgtgcaaaggcctgctggcattttgcctatgggaattctgaagtctgggcacataaggttcagctgcagttgcagttttcaacagtcgtccttatttttataaacattgttatgattattcagacacggaacttgtgattacactatttgctcctgttctgaacttgagggagtccacttaagctaacaagtaggtttttgaggacatgtgtggcaaatgcttacccagtgaagggattaaggggctcagtaagcacttgtccattggcacaatggctgccaatctaattctattgattcctctaaatgtttctggagttcagaaatctattcaatccaagggcactttacctggggtcctgggagccaaatgttaacgtagttcttaaccttcctaagcctcttaaccttctgggtacaacctctatatttgtcttctggctaaaatcatttccccacccccagcccagtcctttggactctcccaggccaattcctggcaagatctttgtcgaactgtatttgcaaaccagggtctggggcacggtggcagttccttcgtctgctgttcccttaatttcgtctggtttcactggctccaggacagcacacggtctagagtgggaagagtgaggcattcaccttggtgaaaaacaactcagtaattaagacaaatgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtacgtcctgggatccaggagcccaaccaggaagtggggggaagggtcgcacagaaggcgggcgcccgaggggtggcggggagcgaactctaaagacatggccagggaagcggcttaggagaggccagagcggggcgcagaggcagaacagaagtcaaactggtgggaggcgcctttagtgacctgaagtagtgagtctaggaaggggccgggggcagagggcaggaccaggctctcggcatctccgaggcggcggactcggatggagcagtttctgagtgacggcctccccgggcctgggcgtcaagggcgaaggccgaaagccggcgttagaaagaggaacgccagttcttaccgaagacctcaaggtcgcggcaaggagataactgcccgggggaggccatgcgcccgggtccagcggcctcccagcccgcggacgcgctcaaacctcgccgggccggaagccggcgccgggaagcgcgtgtgccttttacgtccgcccccgcgcagccgcggccgctgccgccgcgtctccgcctgcctccctgcgccgcgcgctctccagtgccggctctagagggcgctcctgggctagcgtgtagggctggcggcggcggcgctcgggtcacctctgggagcggagtgggggcggagcgagacggaagcagctcaggagacttgaggcgtaggctgcggtccccaaggtgaccgcgccctatgtgggactcgccctaatgcctctgaacctgggtttgaggtaatgacctttctcctaggtctgaaggtcacgggtccgctggaggatgccccctctccactcagaggggtggaggcttaatgctactggtgcagatcacctcttcccctgtgacagcctcagagggttgggagggtccagccagtatgatatacgaagactagatttgagagaggggagcctaccttaaagggcattgatcgagatggcataagctcttctctttcccttccccatggttataactgtccctgttggcttccttcctgtctgttaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggctctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtgggctttaacgttgtgttcttaggagacagtttaaaagagcattgtaccaacctaacagtccaagagctaaagagttgtttttttaattgctaaaggaagccaagatcatccaatgcaacccttgtgtacagatgacgtgtttaggggatgtggggaaaggaagtcagtaaaactctgctttttggtaaaagcatctctttcctattcccaggaatgcttccggatcccaagaacactcacatcgtcatcagctggatgatcgcacagactgtcactgctgttgccgggttgacttcctatccatttgacactgttcgccgccgcatgatgatgcagtcagggcgcaaaggaagtaagttccacttgagcagaagataaagttgtagtcgtggggcaatctgctgccacaaactggtgatacatacctttaaaatggctgtctgtccaagtcaagggatggggttgatagcatctgtgtctgttccacaactgcctttgagctggcccttcagatgcctatgaatgagggtgcttaaatggtgttagaggttaagaccaatgggtagtctgtattcctgtggtcatagcattaatatttcagtgttgcccatgctaatgtgtgaatgttggatttaaagctgacgttcttagaggtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcatataaaaatgcatatttgagtgctacattcgaataaatactacctttttagtgaatgctacatttttaataaatgctacagtatctccggagatgaagaactgtctttttaaaaccaattgtcagcagtccgcttaacagaataacttggttgtgccacccacaaacatttccaacacattagcaaaggaattcaggcccagtgcatccaaaaaacattgttccattgcctatggatgatcatagctgaatgagctttctccaagaaatactgtgaacccaccttctctagtcctatggttattaatcatgagccatgagctgaattatccactttaaaatggttacgtttgttgcatgaatatcacctcatttaaacttttagaatc[131 bp omitted]actgcagcctccgcctcctgggttcaagcgattctcctgcttcagcctcccaagtagctgggactacaggtgtgtaccaccaagcctggctaatttttgtatttttagtagagacagtttcaccatgttggccaggatggtctagatctcttgacctcatgatccacccacctcggcctcccaaagtgctaggattataggcgtgagccactgtgcctggccagctagagcaa[135 bp omitted]acctccgcctcccaggttcacgccattctcctgcctcag[220 bp omitted]acacaatcttggctcactgcaacctcccccttccagtttcaagcgattctgcctc[134 bp omitted]gcctcccaaagtactgagattacagatgtgagtcaccacgcctggcctcaagccatttttaattccattcagagtagaggattagagctggcacagttacatagtgctgagattgcagtgctgttaaagattatgaagagggccagacattggccacgacctcaaaactaaccttacaaagaggaaatagcatctgccttttgcttcatgctaataagcccagtcaatggagggcatttatgtttattttcaataaacccttatttggaatccatgtgacagtgtttggactttctgtatctcttgattagggctcaaatccagtggattttgccatgagatttgtactaagaatgcagcattatgtctgtcaagccacaactttaaaaatgatagaacgggtgctccatgtgtacatgtaaagctcattcttgaggaatatcccacacactggcatgtataagagctattcacagagaggtctgcatggcatggatgaatgcccaaggatcccagagtttatgtttgtcctctggccaggcacctgaatcgtagtatagcttagttattaagaattctgttctggtatcaaagaggcctgggctgaagttctggactctgatgttcagttgtgttaggccaagttacttaatttttctaaaccttggttttccttatctgtaaaatgaggctattaataatgcctgcctcagagggttgttgcaaagattaaataatttatgccaagcatctaccatagaacataataagcattacataaatggtgactgacagttcttaggaggcagatttcaggggctctagaatcaatcagacatacctggattttaatcctggctctgctgattactgtgtgactttgggcaagtcacttaatccccgggagcctcagtttcctcgtctgtgaagtggggatataatagcgcttatatatttctttccttccttttttttttttttttttttttgacacggagtctcactctgtcgcccattcagagtagaggattagagctggtacagttacatagtgctgagattgcagtgctgttaaagactatgaaatctttaacagctggaatgcagtggtgcgagctcggctcactgcaacctccgcctcccaggttcaagcaattctcctgcctcagcctcccaagtagctgggattacaggcatgcaccaccatacctggttaatttttgtatttttagtagagatgggttttcgtcat[138 bp omitted]gcataagaaagcatgtagagccagaagtatggtgcctggcatttagcaagcactccgatgtgaactttcacataatacggcacccaggtttgttgagtgaagatttgcccaagtacagcactgcttaagaatgaattcaagctcacctttctttttctgcaacagactagatatactatattgtgtagcatttatacaaaataaacttcaggttagttctttttcagttgtagattttattcttgaaaggggataagaggctctccagtaagggctgcatacacgatgcaagaggagccaagccccctttatggttattacaatagatgtggactcactgagctggcagctattaaaataaacctaggaccaggcattaatgatcagaaagcaagaagtggtgcctcctgcaattgggtagctgacatagatgaggtgggggttttttttgttgttgttctttctattcttgttcaatgatttttgaaatttaatttaaagacaaagtggttttaatctctccaagctgtgcaggatagtgctatagaattcattatgtccattacgctcatgcgaacgttgatggtacacaatcttagcaacaccctaatttatgccgttgttttgttactattcaatacataacaggatccgtgaagcctgattccaggtgagagagccagaacacaggtcagcttgtgcacagccgtgcttcctattccaagggccctctgcactcagtgactggaagcagcgcgctacgggcgctccggaccgccggagaaagaaacgaggggtgtcttcccagagcggcagttttcgtgaatggtaagtcatttaaaccgtcatttttttgtatcaaaagagatgcagagatgctagagagtctattaatttgaaggcattttaaaaacataaactgcaaagagagttttggtatacaagggccatttctggcactgcccccagactccaattcagtctcctctatcattacagatactttgggagaaaaaatttttaaagtactgctgtactgtatcatagattttcaagcatccgtgttactggggtaaattctatttctcctttgaagtttgtgaacgtagtatttctaatttgcttttgaggtttttaatagttaacatctgtacatggtaataaaagccaaatagtaaagaaaatatgtaaaacgaaaagtaaacatcttcctgtcctgcgtttctcatcactagccccctcctcaaaagtcaccgttattagcaatttcttggctatccattcccccaaaattaatgcatattgctgtaacggctgctgatttgttttatcggaatcgtattctgaccacctggattcaaaatggcatgattcttttagaaccgagtcatactgtggagtaccaggactaacagaagctgtcggaggcaggagggcagggaaagggtagcttccggactctgagcaaggatttctaagtgtggccatttattaaaatcctaacctgggatttttttttttttttttttttttttttttttttgcgggggttggggggttagttttggttgctgagtgacctggagacaagtcacttctaacatcagggtcttagtttcttatccttgaatggagaaatttggggaagagacaaactctaaagtcccttctagtttagacgtcctccagctccatcatttttgcagaaagcagaaccagtgaaaggaccaggattaggtgatttaatcctttcagagaacattttaaaatatctaacacaatcgtaaatgaatagtctctgactcagagcagtcatttacagactgtgtgggtggtttgccattggcaagtaaaattacgaatgtaaagatttacattaatttcaggaccaagaagctgagcaacaaattacagctcggtgtttgggtcagaggtgctctgatttacctcaaaataattaacatctgtcttctcaaagcctcatcttattatgtgtaatgtgcacttccgtatgcaggttgagatttatttgaacaacaaatattaggcgctgcaatttcggacacaaaaatgccttgtgttccactccaaatgtttggaggagctttcctatcatttcagccattatttgctttatgtgcaggtgaacaaggtcagatgcatggtgctcttcttagccaaaggcttaagagagcctttggtatcccggcaacaaatataaacagtattcaagcgacagattgggcagttgctttcactagaccctcatcagagacaaaactgagttaaattaaaggagtctattaatccttggcttttccgtgactatcagggaaggggacagagaaacgagggggttatttttatggcgagcatccatcctgggatttcatttccttgggcaactttcgtaacatggggaggcaatttagcactgttgagattttagagaacatgccgaatctgatcacatgacatgttacactgtctctaatgttttcagtcccagaatagagatggttatggttgcaaggacataaccagaataaagtatcagttaaatagctgttgactggtaacttccgagggcctcgtgtttgggaatgaaaaggaaaactcttctgtctaaatgaactccaatacccagtttggcaagaagcagagatatcttatgggcagaggcaaaggcagatgtactgtggagctaggggtgcttcccctttggagccaccccttgcatgggcccctcccaagccctaaccatatattcatttggtcatatggtttggcaacattttcaaaagacatattttgtgtttttaaaaagagggagccaaatcatataagctgacacttccacaaaactcagatccattcctgcccgtggaactggagtggatgaaggaatttggaggcagccctgtacatcagggagaggtctggggcttcctcaccacctgaccttcctcggagcacaccgctcaggactcactcatgagaagctttgaggctagaggtctcattttcaaataccaaactttcttacttgacaacaattcaacttttacttaactgttttgtgccttagtttccccatgtggaatatggggataactttagtacctacctcataggaatagtgtgaagattaaaggagttaatatatgtaaagtgcttagaacaatgctgggcacctgctttacacaattttgctcttattatgactgttattgctttgtttttgtttttgagatagagtcttgctctgtcacccaggctggagttcagtggtgcgaacttggctcactgcaacctccaccccccaggttcaagcgattctcctgccttagtctcccgagtagctgggacaagaggtgcaagccaccacacctggctaatttttgtatttttagtagagatggggtttcaccatgttggccaggttggtctcgaactcctggcctcaagtgatccaaccgcctcagcctcccaaagtgctgggattacaggcaggagccactgcatctggcccgactgttattgttttattgaaatgctttaaattattttcacttcattcatgggagaatggtttaatggatttatccttttcctgcagattttctaaaacagtctcaagaaaatgctatatatactatagaaagtggatcacacacacacacacagagagagagagagaaggttgtaaagaaagaaaaggacatttttggaatggactgaatgaatagaaacatgtgcttatggtgataatcctgagctctaactcagagcacttattttacaacactgattatgaaagagaccaaaggtcaaagataaatccgtcctgcctcacaaccagactgcactgctcacctgacccaggggccactgtgtggtcaccaggattcttctcacagcttcctttgctctcgtagtatttcaaggaacccatgaggtcccagcctgattacccaaccctatgacttcactccctagggaaagaagctgcagggaggagaaaatttactgagacctttagaagcaaaggatctcctttcactttcacaactaagtccagggttcaggagtccatttattacaaaaattgagcttcataatggctttatcccagaagtgaagatcagggggtaaggacgcttgggcttctgggtaaaagcgtgctgtttgccaattagggtagaaagctaggagtttgaccactgaaattgtaatcccacttcggctccatgtttctttgtcttgggtcatatcacatcccgtcactagttagtggctcagtttgtctaccaggaaacctggaaatcaactttcctttttaagctacaatataattcctcaaatctactgtgggctgtggttctttttggagtttctagggctagatagattgaattaagttaagcctgcgtcttcaggttaaacaatcgatacaaccaggtaacagtaatttctctaaaactacagaatcaagatcatagctcattattttgacatcttatatgccagatgttgtgctaagcactttacatggattaactgtccctattgtctcaacagccctaagaggcaggtattattattcactccatttcacagctatgaaaccgaagcttagagagatgagataatgtcctctgagctatctgactcggcaaaaggtttcaaagagaacttcaaggtgaccctgtccaactatttattttgggtcatgaactatattaaaatatgaaagccggctagtttcaataccaactgacaaaatccatttgacaaatattaaatagaaattataataacctcagttggataaaaaaagagataacaaaagaaaaaataaattataataaccaaagcactgtttgtaaagtccatttttagagtatgggttattttctattttcagccaatttaagaattatggtcattaaaaactacttgaccctaaagctctagagttaaatttgaatttattcacatttctttggcttttccaagacagatcttccttttaaatgacggctcttcacaaggaatactgagcctctctctaaggttacaagcctgaggctggggtcattaggactttgcgtaaggcccataccaactaacaaccacaggaggagttggtgttggccgcaccct[133 bp omitted]caacgtggtgaaaccccgtctttgctaaaaatacaaaaattagctgagtgtggtagcgggcacccgtaatcccagctactcaggaggctgaggcaggagaatcgcttgaacccgggaggcggaggctgcagtgagctgagatcgcaccattgcacttcagcctgggt[137 bp omitted]gtggcaggtgcctgtagtcccagttacttgggaggctgagg[139 bp omitted]ggctttgggctattttatctgattgcaccttatattgagagacagtactgtgcgcctcatgttctgttcctcctcctgcacgtgatctgcagttccacttgccatttcctacctatgtcattcactttcatatttccaagcttggctgtactattgtttttcccagcatgcccttacctgcccctctgccagggcatgatccttcaagacccagctcagattgcaccacctctgggagccttcccagactccacctgcccatactcattgctctctcctctgtacttctaaagtaatctatctctgtcagcttcacaaaggcagatattttgtctgtttcattcatgtgtccccagtgtctagaacagtgcctggcacatagtagatgttcaagaaatagttgttaagtgaatgaattataatgtttatttcatggtatcacaaccaagtatttatttgtctgtcctcattaagggctatgtctcgtttctctttacattcctaaaactgagcatagaacctaacacatagtgaatgtgtggtaaatgtttgctgaaggaggagataaatgagaaaatgggccaagtgcagtggctcacacctgtcatcccaccactttgggaggccgaggcgggtgggtcatttgaggtcaggagtttgagactagcttggccaacatggtgaaacaccgtaactactaaaaatacaaaaaattagctgggtgtggtggcacatgcctgtagtcccagctactcaggaggctgaggccggagaatcgcttgagcccgggaggtggaagttgcagtgagctgagatcgcaccactgcactccagccagggcgacagagactctatctctaaataaataaataaataaataaataaataaataaataaataaataaaatagccaggcacagtggctcatgcctataatcccagcactttgggaggccgaggcagtcgaatcacttgagattgggagtttgagaccagcctggccaacatagtgaaacccaatctctactaaaaatacaaaaattagctaggtgtggtggcgggcactgtagtcccagctactcgggaggctgaggcaggagaatggcttgaacccgggaggtgtaggttgcagtgagccgagatcgagccattgcactccagcctgggtgacagagagagaccctgtctcaaaaataaataaataaatatctgtataacgaaataaatagagaatgaatgaatggcatgttgtagggtttgtgcattggttattgattggcatgaatgaattttggctcgatccagccacttgatacctgggaacaattctgtagcaataaatgtacagggcctttctttttcattttcttacataataattcagcaaatgtccggggccttttgacttgcagctattgtttttccagaccctgggcttacagggaagatctggatattgcaggggttgggaaatcaactggttcctgtactgctgctatgttgtccatgctagagaaccagagaggcgggaccttggcacacacccctcccctcctgaaatctgtgtgaaaaacagctgactccacatccagggcttctaccatactgtgttcatgggatgctggcctgtgccacacatgtgctggccatcttgtcatgagcccctaacacagagccctccacatagtaattgcctgatggatgtctggttgtgatgatgacaatattgaacagtggctgtcacacaacatgactcaggccactccaaggggagaggaacagacatgttcctggggcacctgaggacgctgccgatagagctgtgccaactgcacgcccatgtgactgattagggctgattaggccagacctgctcccagacctgggcctaatgttcccagcttctaagactatttcagccactaaaagcccatgagaacccttgagtgaatgtggccctttttgacgtgctcaggaagcaggcagagtttgttctctctcacttgtgagtgggaggcctccaggagtgcagcagcggacttgctcagtagtaacatccattgtcatttcttgagctttgactatgggccaggcactcttttaattgtggatactcatttaatcctttcagtggccttatgatgcaggtgctaagattaccatttcccagatgaggaaaccgaggcacctggcaaaccacgtgtaacacctgcagatgaaaaccctgaaaacaaagggaacccccccccaacttagagagagtcagaaagtagcacttaatgctgcggtgcctggaaaataaccacggaggcccagaggaagggaggggttcaagctctttagggaccatcggcctgcttggggacctacccatgtgaggagcccctggagaggcgcttggtgcagtggttaagagcatggttccgcccctttccagctgtgaaatggtgagcaagattctaagtctcactgcctcaccttgctcagccggaaaatggggtcaagaacactacttgcctggcactgtagtgaggatgaaataaattaatatttgcgaggcgcttggcacaaagcctagcatataatatgcgcttaagtgtttgttaaataactacgggctctctcagagtcggccccttccctttaggcgccggttttgtaatctgggaaactttgtaaagagcgctctcagcgcggtggctaaaacagtccgctaggactatgccgagtagcagcagaaggaaatggcccggcccgccaggcggggagctgcagacaactaggagagaggagggcagggcacgccctgagggaaaaaacgcggcttttgcaggcctaatggcggttgaaagtcgccgaagtgcaaggctggattgagacagacaggctgaaaaagtcgcagcgcagccgcagcggcagcagccgatggccgactccttccttttccagtccacgtgcccaggcgggtctccggccgcctctcgcacctgcctgcagagggcgcgctgcttctcgcctcggcctgggcaccgcggccgactccgctggaagagctgtgtcctccacgcagaccgctttccaccaagctcagctaaacccaccgcccccaagaagtctaccctggccgctccagccaagctcttcctcccctgaacccccaaagcatcatcagcactgcataatttagaacttggatatgtgctggctggtcactgtgtcctacgtatgggacaaatcttggctcaacaatatcatactttgcatttctcccccgagtcacacacggccattggcataccggcagccacatagcgtgtgcccagcaaacacctggtgtacctctactgggtctcactgtattggctcccaaaggagactctcaggatccctgatgtcgccaagccctggggtggcagaagggacacctgggaggatgcctgcatggcctcagttgccacttcgagccttcactgaccaaatgaggtcggtgtagcccacctcagaaggcaatgccttcgtgcaaaggaaaccctctgccagggaatccattgatatggaaatatttgctgagccccagctttggtgcagagccctgtgctgggcaccagggacacagtgaggaatagaaaggattcttgtggtgatgggaggcagtgtagaaaaattagaatagcaagagatttaaagtcaggctgggcgcggtggctcacgccggtaatcccaacactttgggaggccaaggtgggtggattatttgaggtctggagttcgagaccagcttgaccaacaaggtaaaatcctgtctctactaaaaaaaaaaaaaaaaaaaaaaaaattagcagggcgtggtggcgcatgcctgtagtctcagctacttgggaggctgaggcaggagaattgcttgaaccccgggaagtggaggttgcagtaagccaagattgcaccactgcactccagcctgggcgactgagtgagactccgtctcaaaaaagaaaaaaaacagagagagatttagaatcagaaaatcccccacaggcactagctgtgtggccttgggcacaccatgtcacttctttgagtctcagtttcctcttctgtatctctgagggagtctggagtagggtagcggtggtcagatctacaatgatagccagatttataatgttttaatgttcatgagaacatacttatccatgaagtaagtaatttaaattacatttttaacagtacacattttttttttttttttttagatagaatctcgctctgttgcccaggctggagtgcagtggtgccatctcggctcactgcaacctccaccttctgggttcaagcgattctccagcctcagcctcatgagtagctgggattacaggcgctcaccaccacacccagctaattttgtatttttagtagagatggggtttcaccaggttggccaggatggcctcgaactcctgacctcaagtgatccacctacctcagcctcccaaagtgctgggattacaggcatgagccactgcacccagctttattccttcgatttagctgtaactttgtaaccaacctctccctatcctcccctcccctctacctttcccagcctctaataatcataattctactctctacttctatgagctcaggagttttttttagctcccacatataagtgagaacatgcagaacatgcctgacttatttcacttaacataatgtcctccaggctcatccatcttgtcatgaatgacaagatctcattcttttttatggctgaataatattctgctgtgtctgtgtgacattttctctatccattcatccattgatggacactaagatagattccatatcttagctattgtaaatagtgctgcaataaacatggggaggcaggtatctcaatacactgatttcctttttgggggtatatatccagtagtgagtggaattgctggatcatatggtagtcctatttgtagtttgtttttttttttttaagaaaccttcataccattttccataatggctgtactgatttacattctcatcaacaatgtacaagtccccttttctctgcatcctccctagcatttttttttttttgtctttttgacaatagctattctagctggggtatacattatatttttttaaattgaagcataaaatggaagtgatggtgttttgtgaaaaccaaatgataaaatagttatgaaagctgttgtaactgaaagaggcaccacaaagtttcattatgtttaccactgctaaaatatataggaggcacccagttaatgtttcttgaggagaatggaaatgtttcctgagtgataggatccatatataaacatgagagttaagagtgccagaacatctgacatgtgccaaatgcgctgtccagatgataagtatttaatggattctcttagagagcaatcactgggcggggtggtcagggctgcatggtggaggtgagatttcagttgggccctgatgatggcgttgatctttggtgaagaggcatgaggaagacaatccagacagagggaagggcatgcactaagggcacaaaagcaggaaggtatgaatgatcgagaatgccaagtgcaggagggcagggccctctgcctctgctctagcctcagtgcctagcacagtccctgacacatagtaggctctcaatacatgtttgtggaaggaagggagggagggaggaaagaaggaaggaagagaggaaggaaggaaggaaggaaggaaaggaaaggaagggcggaagggtgggccaggtgtggtggcttaccactataatcccagcattttgggaggccaagatgcgaggatcacttgagcataggaatttgagaccagcctggccgacacggtgaaaccctgtctctactaaaaatgcaaaaattagctgggtatggtggtgggtgcctgtaatctcagctactcgggaggctgaggcaggagagtcgcttgaacccaggaggtggaggatgcagtgagctgagatcacaccactgcaccccagcctgggcgacagagggaaactccatctcaaaaaaacaaacaacagcagcagcaacaacaaaaattagctgggcgtggtggtgcatgcctgtagtcccagctactcaagaggctgagacaggagaatcgcttgaacccaggaggtggaagttgcagtgagccgagatcgcaccactgcacaccagcctgggcgacagagcaagactccctctccaaaaaaacagattacatgatacaatgtgagtaaagagcctgctgcaaccctcaaggacaattggtggccattgtgatcacaccccttaggctgaagcagatttcggaggagtgctttgcatacagtaggtcatcagctaatacgggttgactgagaggaagtttggggccttgaaccttttatccgtgtaggcaatggggagcttcgcacacaaagtagggtgggtgttggacgatgaacacagatgtggacaatgggttagacaatcaacacagatgtggtgtgaggtgtgggttgaagtggaggaggaggagacacaggtatcgcagttgttgcaacagcaaagggattagtgacaggctagggtgatggcaatggggatgaaaggacaggtagggcagagaaagcaaataacagaacttgttttttgttgttgtttttgagacagagtctcgttctgttgcccaggctggagtgcaatggcgcagtcttggctcactgcaacctctgcctcctgggttcaagcgattctcctgcctcagcctcttgatgtgtccggaattggtgggttcttggtctcactgacttcaagaatgaagccgcagaccctcgcggtgagtgttacagctcttaaggtggcgcgtctggagtctgtcccttctgatgctcagatgtgttcgaagttttatccttctggtgggttcgtggtctcgctggctcaggagtgaagctgcagactctcgcggtgactgttacagctcttaaggcagcgcgtctggagttgtttgctcctcctggtagcctcgtggtctcactgggctcaggagtgaagctgcagatctttacagtgagtgttacagctcataaaaacagtgtgcacccagagtaagcaataacaggatttattgcaaagagcgaaaaaacaaaccttccacaccatggaaggagaccggagcgggttgccaatgctggctgggcagcctgcttttattctcttatctggcccccacccacatcctgctgattggtagagcccagtggcctgttttgtcagggcactgattggtgcgtttacaatccctgagctagatacaaaggttctccaggtccccatcagattagttagatacagagtttggacacacaggttctccaaggccccaccagagcagctagatacagagtgtcaattggtgcattcacaaaccttgagctaaacacagggtgctgattggtgtgtttacaaaccttgagctagatacagagtgccgattggtgtatttacaatccctgagctagacataaaggttctccaaggccccaccagagcagctagctacagagtgtcgattggtgcactcacaaaccttgaactaaacacagagtgctgattggtgtatttacaatccctgagctagacataaagattctccactgtccccaccagagcagctagatacagagtgttgattggtgcactcacaaaccttgagctaaacacagggtgctgattggtgtatttgcaatccctgagctagacataaaggttcttcaaggccccaccagagcagctagatacagagtgtggattggtgcactcacaaaccttgagctaaacacagggtgctgattggtgtatttacaatccctgagcgagacataaagacgtccccaccagactcaggagcccaactggtttcacctagtggatcccacactggggctgcaggtggagctgcctgccagtcccgcgccgtgcgcccgcagtcctcagcccttgggtggtcgatgggactgggcgccgtggagcagggtgtggtgctcgttggggaggcttgggccgcacaggagcccatggagtgggtgggaggctcaggcatggagagctgcaggtcccgagccctgccctacgggaagacagctaaggctcggtgagaaatcgagcgcagtgccggtgggccggcactgctgggggacccagtacactctccgcagccactggcccgggtgctaagtccctcattccccagggccggcagggctggccggctgctccgagtgcggggcccgccaagcccacgcccacccggaactccagctggcccgcaagcgcctcatgcatccccggttcctgctcgcgcctctccctccacacctccctgcaagctgagggagccggctctgcccttggccagcccagaaaggggctcccacaatgcagtggtgggctgaagggctcctcaagtgccgccaaagtgggagcccaggcagaggaggcgccgagagcgagcgagggctgtgaggactgccagcacgctgtcacctctcactgagtagctgggattcgattacaggtgcgtgccaccacacccggctaatttttgtatttttagtacagat[150 bp omitted]ttagaaaagagaaataggtattaactcagaaagatgcagagacctgctacgtgtgttttactgccaaaaagcacagagctgagcctgtctaccacctcctgtcaaagtgtaaaataacccggaagactcacagggggttctgctggccctggtcagtgaaagttggaatggccagttcccagacgctgcaaattttttgggcaataacattttcccaggaattttagagactgccggattttttttttttttccttctcttccttcaaattgtcaggacagcaccgtccacaagggggcagattatatctggcaaagtccaattacgatggcaatactagtgatattaaaaggcaatctcctggccgggcgctgtggctcatgcctgttatcccagcactttgggagtccaaagtgggcagatcacttgagatcaggagttcaagaccggcctggccaatatggtgaaaccccatctctactaaaaatagaaaaattagccgggtgtggtggcaggcgcctgtaatcccagctactcgggaggctgaggcagaagaatggcttgaacccgagagaatggcttgaacccgggaggcggaggttgcagtgagccgagatcgttccattgcactctagcctgggcgtcgcagcgagactccatctcagaaaaataaaaaataaaggcaatctcccctcataggtgcttcagctatctgaacaagcacaaagaggatatcaatgccatccatttcccctgccctattagcaggagctgcaacgtcagaggtgtgcgtgttgccatatggcaatgaggcgagctctgggaagccaaagagcccttacccgactacaggggacattggttattggccaaacttgacacttcctcctgcttctagctcctggacacctcaccattttcatctccctaacagggccaggaaacagcagagtgtgaggcccagtgggcctgatggtgctaggaagacccctgcaaactgagatcagttgggcaagtgcccactgcaagctgagcccaggattgggtgtggggaggtggaaatccaggagaaatcaaagactccttcaccaaacccaatctgatggaagagaaaaggcaagcccacattggttcagagatcacagagacctgggttcagatctcgatcccatcacttcttagcactatgtcataagtcaggctgctgaacttcctgaacctcagttacctcatctgtaaaatggggagggcaaaaacagtatccacctcacagggtggttgtggggtttcagtgagatattgcataaatgagatagagcctggctcacaggtagtgctcagtaaatggtagctggaatccatgttattgttccagtaacaataaagcaatgtggtaccattgactatactgagtacagaaaaaccttggaagacacaagtggcaggtgagtagaaagtgggtttttccctgactgattgaaggtgaaggggcaggaggtgtgagaacggagcagggagggcattccagaaagagggaaagacaggatgtcttcagggctggtcccatgggtctgcatcggcaaggatggaggctgctgtgatggggctgagtggtttcaggcccagcccagccaggtacaggcagctgctcag[134 bp omitted]tggccaacatggtgaaactccatctctacaaaaaatacaaaaattagctgggcatggtggcaggtgcctgtaatcccagctacttgggaggcagaggcaggagaattgcttgaacccgggaggtgtaggttgcagtgagccgagatcatgacactgcacttcagcttgggtgacagagcgagactcggtctcaaaaacaaaagtaaaaacaaagaagtaatatgagggaaagagtgtctcggatgattgttagagaagtctcttggtctccagccacagcattttagaagaggaaggcaaatctatgacagcaagctaaggaagatgaggcccaatctccctctgcaggtgcagagaagccaataatatgggataagcgactctggaagtttctttcttctgggcctgaacatatgtctagaattccaagaacatgacccgatgggacccagaagccagcccacaaaaccctcagctatcaactacaaaatgctcatcccgggcatttgtccccccaccacccccaaactccccaccccagggacagtaaactggaaggctattcttgacatttctgatctcagagcccggtctaaggttttcatttccatgctgggttttgtttttttgtttgtttgtttgtttagacagagtcttgctctgtcacccaggccagagtgcagtggcgctatctcagctcactacaacctcaacctcccgggttcaagcgattctcctgctcccaagtagctgggactacaggcacacacaaccatacccagctacatttttgtatttttagtagagacagggttttgccatgttggccaggctggtctcgaactcctgacctcaagtgatctgcccacctcagcttcccaaagtgttgggattacaggtgtgtgccaccgcacctggcccatcctggttctataagtttaacttcccccgtgagtagatctttttagggcgctgacagagccagcagagctgggctcatttcctgtttgcccagatgctaagcttccatataacccttggttacacaggcccttggaaggaagccttggcctaaatagccccaaacaagtgataatagaaaagccttttatatttagcttttggatattgtaagtgatttttggcagcatatttctcttcctaaatagagctggattgggctaattaaaattaactttatgggatgcagaataggagagtggttaagagcctttatagaccagtggtatgggcgctcagccacacagtctggttttcagtccaatcaccaccatttgctagctgtttatctccctgagtttcttcatctgcaaaacacagatatagccagaatacctttctcattgggtatctgtgaggattgcatgaagactaatacatataacacagcctgatgtctggcccctggaagcattcaataaagggtggcagtcatagttatcatgacattatttccctagtagacccactgggctttggataaaggaagtctaaaggtagcctgggggaggggtatatgagggaaaatcaggccaggattaaaaactgtcagcataggcccggcacggtagctctcatctgtaatcgtaccactttgggaggcagaggcaggtggatcagttgaggtcagcagtttgagactagcctggccaacatggcaaaaccctgtctctactaaaaaatacacaaattagccaaatgttgtggcaggtgcctgtagtcccagctacttgggaggctgaggcagaagaattgtttgaacccgggaggcaaaggttgccgtgagccaagatcgtgcctgggtgacagagtgagactctgtctcgcaataaataaataaatacatacataataataataaattgtcagcctataatccagaaaaaaacaatccacctgtggataatcgagttatccacttcttattctttttttttttttttttgaaacagggtctcactgttgcccaggctagagtgcagtggtgtgatcagagctcactgcggtgttgaactcctggcctcaagtgatcctcctgcctcagtttcccaaagtgttgggattacaggagtgagccaccactcaacggccagaacgtgatttcttgaccctttttctcaggattgtgctagctcctcagcaggtttaggctagagtgagcaggtggcattgccccaagaccagttggatgcagagtctgtcaggaatcacttctctatgcaagggagtaggtctggctaggcacaggtatgtgcttgcaaggtaaatagttgttactgacacagtcacctttgtctgtgaggggaggaggaggccaatgcctatggaaggacaaaactccttcagccttaggcaggtcttacctgcccctgcattcttgtcaggttatatattgctcttgtgatgtgtttggaaaaagacaagaaaacatacttttttttttttcttctagccaggacctctggctagaggtagagggacttcttagacgtcactatcatggctgaagcctcaattctgtcctaagccaggaaaccaaattggtaaatttggtctttttttttttttgacagggtctcactcctgtctcccaggctggagtgcagtggcacaatctcaactcactgcagcctcgatagcccaggctcaagtgatcctcccacctcagcccctcaagtagctggaattacaggcatgagctaccacggccggctaatttttgtatttttagtagagacagggtttctccatgttggccaggctggtctcgaactcctgacctcaggcgatctgccggcctgggcctccaaagtgctgggattacaggcgtgagccatcatgcctgggctagtaaattcagtctttatatcatggttcctccattgttgtcaataactctagcactgtgaacatgcttttgtgagctgatgctgctatttacttctctatttacacatttacgtatttgtgtctccctgataccacatttatcttttgaatgggtaatatattggtaatatatcctcggataccaaattgacaaggtataaagggtttacagtaacaagttagtttccctcccacccctgttccctcgccacccacaggtaatctccatgaccacattctggtgttaccttccagagataagctatgcctatccaggcatctattattttaggtggtagcattcttactcatatttgtatcccagtgcgtagaggagtgccaaacaaaagtatgctgtcaaaaaaagcttgttggttgcatgtttgttgctccagatttgttgccctcatcccagccatgggtgcctgaactctctagttgaaattttcatgagcttatcaaaattttacctggggccaagcgcggtggctcatgcctctaatcccagcactttgggaggccgaggcaggcggatcacgaggtcaggagttcgagactagcctggccaacatggtgaaacctcgtctctactaaaattacaaaaaaaattagctgggcgttgtggcgggtgcctgtaatcccagctacttgagaggctgaggcaaggagaatcgcttgaagctgggaggcagaggttacagtgagctgagattgcgccattgcactccagcccaggcaagagtgtgagactccgtctcaaaaaaaaaaaaaaaatttttttttttttttttttacctgtttggacttgcagctctggctttattttctccagactgaaatttacaaagaagctactggggccttgcctaatataaacaagttattctccttcacaatagaactctaaagagcaccctgatgcatgaattttcttccctgctctgttcagtgtaaaacagaagcttagccccagctcctctttgttaggtgactgttccctgaggcaagggttaaagagactttgatgctgctcatcttaggggagtctctaagcatactcatctcagaattctggctcaggaaataaaatgcaggagtttccactgcagtattcctcagtccttgacagagctgggttttccagaagcatccagacagcagtgccaccttcatattctctcatattctctctctctctctctctctcacacacacacacacacacacattttttttctccctgatgtggctaggggacaggctggactcctgcacttgatccatataaaagaacctaaggaagaaagaaaaagggaggagtaagagggccactccctgtcctgttctatgatcacgaggcttgtaaactcaaggaggcagcagggcagagtgccgaagcaaacagaggctgcctgggctggaatcctgactctgccatttatcgcctgtgtgactttgaaaccacctttgcaaaattataactgaggaagttatgatagtgaaagaaaacagacctaaccgattccatcttgcttctaacctttaagctgtccttgttcattcctgggcataggccgaactctccattgcaattcccctgtcttgataaatcgtctctatctaggcagtgagcaaggtgaacccactgggtggttacaactttggacaagttatttaacctctgtctgcttccatttcttccaccgtaaaatggggataactgtacctactttaaaagacttgttatgaggattcagtgagttaacagattgcaatgcatttagaacggtgcctgggcatgtggtaagtgcaatatacatgctatttatttatttattgtttttattttattttatttttgagacggagtctcactctgtggcccagggtggagtgcaatggcgcgatctcggctcactgcaacctctacctcctgggttcaagcaattctcctgcctcaccccccaagtagctgggactacaggtgcccaccaccatgcccagctaatttttgcatttttagtaggcacagggtttcaccatgttggccaagctgacctcaaactcctgacctcaggtgatctacctgtcttggccccctaaattgctgggattacaggcgtgagccactgcaccccgcctatacatgctttttaaacaaaaagaaaaacgtccatgtcagtggttcccgtgttcgatgcatgtccctctattccctggctgtaagtttcaaggttttcacttaccgatcttgggccctttggtgcattttttttcctattgggaaaaagctaaatgttgtgttgtatggtgcatttcttacacagaaaggaaaaactaaaaaatagcctgtatctaggctaaaattcctgtatagaggcaagattgtgtcatctaaagttcttactacattgactttttcctgatgctgttcttggggcccccactctgcctctagagggctggtaagagtccacaggagagcttcccaagccagtgccttttaggaagagttgctgtggctactgagctgatcaaaggtctcagcctccacaaagaagcatgtgctgctgtggcaatgggcctgagggtacgggggccccagggttgcagggcaagacaacaatccggaatccagctgttgtctcggccatcatctgaggtcatcctgccagattggcaggctgtgccctagaccacagaggtagcccctgctcttcaaagggctggattgtcagcccagcccctcctaggccttctcttcaggcttcttctttctacattatcccaacacaaacagcttgacttccaagtgacattgcaccagaaagacttccaaagtcagctcacctatcctagggatctagcccggccaggggctcctatgagggattccataggaggagtcagagactgtcatctaggaaggcttcagagcttcaggataggtcctgggcaacccttgatcgccctcagagactcactcaggttttggcgtccctcggttacagaaaccctcatgaccctaatcacattgcaactgcatttccttcctgtgcctcgggctcagtcagggttgggcccaggtgtgccagaacagcaggcgttcaaaaagcacatcgcttgcttctcagatcttgctcacaaacagttttgtgcagttctatggaaaggaaaaaaaaaaagtgtacccttaacaaccaatatacacatacagactcattcagtgaacatttgttgagtgtctgttatgaacaaggtcctgtaccaagtaccaaggggaggggaagaggatgcaaagttgacttaagcatagtcctttcccttaaggactttgtcctctgccagagaagccagtcacacatatataaatggaattagtttattagtttaataaagtggaattaaaacaagctgtaacataagaccaaactatttattgacttgacatttgctgaacagatattgtgggccaggcactgtactaggagcaagggatacacagcagagaagaagagagaaaaaatcctacccttatggagcttatatcccagtgaaggaggcagagaagtaagaattacaatatagtgtgacaagagtgttaagaggggtcagcagactgagatttgggagcaaagaaggaagaatgtttaactaactgacatttggggaatctggaaacacttccgagagaaagctccatctcggccgggcgcggtggctcacacctgtaatcccagcactttgggaagccgaagtgggcagatcacttgaggccaggagttcgagaccagcctgggcaacatggcaaaaccctgtctctactaaaaatacagaaattagctgggtgtggtggcacacacctgtaatcccagctactcggggagctgaggcaggagaattccttgaacccaggaagcagaggtggcagtgagtcaagatctcactactgcactccagcctggttgacagagcaagattgtgtctcaagaaaaaaaggaagtgccatctcaaccacagctgccatgtggcatggctacagtgtgaatgttgtgcattaccaattgtaacagcccaggctgaaggataaataggagttagccaatagtacttagcaggtgtggagaaccaaaagtggttcaaaatggctagagtgcaagggccatctggcaaatgtggatggagggagcatgagagttggaaacacatcattttgcaaatatcattataaagattggatgggccagatgtggtggctcacgcctgtaatcccaaccctttaggaagcttaggtgggaggatcacttgaggccaggggttcaagaccagcctgggcaacacagcgagaccctgtctctacaaaaaattaagaagataagctgggcacggtggtgcaagcctatagtcttagctactcaggaggctgaggtgggaagatcacttgagaccaggagtttgaggctccagtgagctatgatcgtgccactgcactccatcctggggtacagaatgagaccctgtctcaaaaagaaaaaaatatcggatgaaacacaacatgccaaaatctgtgggatacagtaagagcagtactaagaggaaagtttgtaccaataagcaactatatcaagaaaatataatgatttcaaataaacaacccaacaatgcacctcaaaaaactagaaaagtggctgggcgcagtggctcacacctgtaatcccagtactttgggaggccgagacgggcagatcaggtcaggagattaagaccatcctggctaacgcggtgaaaccccgtctctactaaaaaaaatacaaaaaattagccggacgtggtggcgggcgcctgtagtcccagctacttgggaggctgaggcaggagaatggtgtgaacccgggaggtggagattgcagtgagccgagatcgtgccactgcactccagcctcggcgacagagcgagactctgtctcaaaacaaaacaaaacaaaacaaaacaaaaactagaaaagcaagaacaaaccaaacccaaaattagtagaaggaaagaagtaataaaggccagagcagaaataaatacaattgagacttaaaaaaatatacaagatcaatgaaatgaaaagtcagttttccactaaagaacttatccatgtaaccaaaaaacaacctgtaccccagaaaactactgaagttttttttaagttggtttttgaaaagatttaaagaaacaacaggccggggcgtggtggctcatgcttgtaatccaagcactttgggaggccgaggtgggcggatcacctgaggtcaggagctcgagaccagcctgacccacgtggtgaaaccccatctctactaaaaataaaataaaaataaaaattagccgggcagtagtggtgcgcgcctgtaatcccagctccactcgggaggctgaggcaggagaatcgcttgagcccaggaggtggaggttgcagtgagccaagatcatgccatctaaaaaaaatgctgcgggaatgttctttagaacatttttttcctctcaagtacaggagctactctagggtcaggtattgcatttagcttttttaaaaatctggaacaggatatctctattcttaggaaatatacactgaagtgtagaggtaaaggaccatgatatatacaacttattctcaaatggttcagaaaaagtgtgtgtgtttatagtatgcatataaaatgtatatacataatgtgtatatattatgtgtatgtgtatatgtgtatatatagtgtgtatgtataaaatgtatatacataatatgtgtgtgtatctgtatggagagagaaagagcgagaaagagagagagaacccaaatgataaaggaaatgagataaaatgttaaaagcagatgaatctgggtaaagattatacaagtgttcctcgtgctctttttatttttgcacattttgtaaatttgaatttttttttatttttatttttttgatggagtttcactctgttgcccaggctggagtgcagaggtacaatcttagctcactgcaacctccgcctctcaggttcaagtgatcctcctgccggcatcttttttttttttttttttttggcatttttggtagagacagggttttgccatgtcagccaggctggccttgaactactgagctcaggcaatccacccacctcggcctcccaaagtgctgggattacagacgtgaaccaccgcgcccagcctgaaattacttccaaataaagagttttttaagtataggacaggagcggtggctcacgcctgtagtcccagcactttgggaggccagggcagggggatcacaaggtcaagagatcgagaccatcctggccaacatggtgaaaccccgtctctactaaaaatgcaaaaattagctgggcatggtggcgcacgcctgtagtcccagctactcgggaggctgaggcaggagaattgcatgaacctgggaggcagaggttgaagtgaactgagattgtgccactgcactccagcctggcgatagggtgagactctgtcccaaaataaataaaaataaataaataaaaataaaataaaaaagtatggcaagacagagtaccaaggattggggagggagtggtgagaaatgaaagcagcagctagttcttgaagagacctgctcaccatggtcagaatctggacttcggggcagtaaaaggtatattcccaaaggagtgaaaggagccaggcatggtagctcatgcctgtaatcccagcattttggaaggccgaggtaggaagatctcttgaggccaggagttcaagaccagcctgggcaacatagagagaccccgtctctacaaaaaaaatacaaaaattagccaggtgtggtggcacgcacctgtagtcccagctactctggaagctgaggtgagaggatcgattgagcccaggaagtcaagtttcagtgagccatgatcacgccactgcactccagcctgggcaacagagcaagaccctgtctccaaaaagcaaacacaggacaaaaaacgaaaagggtgtaggggaaggggttgaccttggaggaagtaccaggatagagaaaagatgggcattttgcaggctgagtagaaggatgcatggtggtcatcttcttagctctggttatgtttgagcgacacatcatagtacagatacaaagatgaatgaggcacggtgggctcttctcaagaagtctggtggtgtcacatcctggagaactggttgcggcagtgtcctggagatgtcagaggcggccacagaagggcacgggcttcaatgtcaccttgcaggactggagaggggttggtgcaagctatatcttatagggggctgtctctccagctggcctagaggatgggggttaagaagagacttgagttttgtaagagaaaaagcctccctcagactctgaagacgatcaggatccgcccacccagaggaagaaatgcgtggctctgtcaacttttcaggtcataggtcttgagtgggagaatgggagccctttttcaaccccacccccaaatttcctcttgccagtttctttctccctcctggaaggaagcctggacaccacattctgggagatcataactctccccctgagagctatttgctggctctccccacagaaagaccttgggagggaagcacagtcacctgtcatggcaggagctggcaagctgagacctctcccttccactggccctgccttcttcagggccaggcttcctcatgggctgtcccttcagaacccagcccacaccttttcaggaagccactccccacaaatcccctctggtcctatggacatgcgcattacccttctctgggccttcccctgacttcctcattggtgtcaatttttttttttttttttgagacggagtgttgctcttgttgcccagcctggagtgcagtggcgcgatctcggctcactgcaacctccacttcccaggttcaagcaattctcctgcctcagcctcctgagtagctgggattacaggcatgtgccacaatgcccagctaattttgtatttttagtagagatggggtttcaccatgttggtcagactggtctcaaactcctgacctcaggtattccgcccgctttggcctcccaaagtgctgggattacaggcatgagccaccgcgcccagcctcaaaactttcttctcagttcacattccttcctttctgccaatgccagtagggtgaatcagataacctagagtggtgagctagctaatatggcagtgctgtccccagaaactactggaataagggggaacatcaggcacctacaacctggagagaaagacttgtcaggcaggtctgcttcctgctgccttgggcacttccttcgggactggtttgttgagagggttgagaatggattggaggggggggtggggatagtgggggaactagaggcaggaaagctcatcaggaggccttgctgcacttccacatagatgggggcctgacctgaagtagtgaccgtgcatggagagcgaggttgttgaagtgaaaacgtgaaggctagaacaggcctgacttgatgactaggcctatgggagtgtgagacgagggtgtgcccagatttcctgcttggccaggtaggtgagtggcagtgccacttattgagaaagggatcatcaggcaggacaaactgtgagtttgagggggaaggaaaggatgacaagttgtgttgggtagattcaatttgagttgcctataggatgtgtaagtggggctgtccaggaggcacttggatgggagtgtgtgtgtttcgagcacagaagcaaagtctagtctggaaacaagagtattaattttctctctctcactgtttctctctccttcacacacacacacacgtgtgcgcgcgcacacacacacacacgtgcaaacaccagaactttcaaagctaggtgcactcacagggtcattaagcccaggacatgttgacaagggtgtggaggtgtcatcctcggggacatgcagggagggttcctggacagtgatttttacatcgcctccttaattgtccataaccataaccatgatccatagccataaggacaataggaattgtggtcccccagagatttttttcctactgaaactccatagtcacacctctttgcagactttatggcaggccttcccttttttccaaacccctgtgaatagtgtcagacagcatctgcgggaggatgtgtgtgaatgctgggatgcagggggcatggcagggagtggagcacttgtaattctgttgatgttggagccctcccctttcagagtgcattgagtccttagtgtgtgccccctcgccccgatcaattcccaatccctgtgttgcagagagggcagcaccaccttctcagccgcacaggatattctcaggctgatgccaagagcaaatcactcccagccagcacacttctgccagccttggtaggcacagcgtgtagcagtgcgcatgtgggtggggacagaggtgacttttctcatagactgggagaaaaaaaaaggcatctgaacttcctggttacagaacatccggctagtagaaacctttgtgtgtttgtacgtgtcgggcagggggggattagtgaggttcccctcccctctagtgttagcaataatgaaggacactctttgtacaagacgtcaagatgagagcttccacacaggactccacactgtgcttctgtttcaccaggaagaaatcttgaatgtcagccaggcttgtactcatcaattcattcagccagtctctgagggctggtccttctactgagtgctggctagggtggggctgaggactgtgcccctggagagctgccagcctaggtgcaaacacagaaccttcattcatgcagtgacatcacagcagcccatcacaacactgccccaactgcatcagagcagttgcacctgataggtttcccaggggttacctgaggagcaaagccaagtgcgtgtggcccaaagtagacagcatatagggcctgcacgctgaggactgccccaaatgctggcccagctttttccaccagggagggtcagattccaaagccgacagccactcagcacgaggcccagacccaaattccactgccagccacttctactgctgaaaaggaaatagggccgaaaatgtagacttcaagggcaaacactggatcacccttgggagtagcttccagagctctgagtaacatcctggaggcagaagagaaatgtttgccctgccccccagcccacagtctccagcatcaccagcctttctggaaagccttccgaagtcaatttcagcccagccaggagcagggccaagttgacagagggctgagccagagctcccctgcactcacaccttgatctttctcttcctcttagacttgagtgcttgccaggtgtgcattccagagtcaatgcaagtgtccctggctctcttccaccccttcccaggcaaaaagaggccacccacccatggaaaagccactgttgtcaatctgtcgccagaactctcgctcaaggtggcagtgaggctttggtgccagctagggtttgctttggaatccaggagctcccatcaaaggcggtgggctatggggtcctgaatgaatggcaaaggggcatgggagtagggatgagggtcattcaggacttggaaatatagttggccccgggtatgtgctggagctggctccctctggcccatgagagccagatgctatattttcagaagttttgtgagtcagtcattaagcatagcacttattttaaaatatataaaattacaattaaataaattatattaaaaactaaggtaatcaatgtcccaaaactcatcatctcctaatcattttactttttttttttttttttgagatggagtttcgctcttgttgccaggctgaagtgcaatggcacgatctcagctcaccgcaacctctgcctcccgggttcaagcgattctcctgccttagctttccaagtagctgggattacaggcatgtgccaccacgcccggctaattttttgtagttttagtaga[133 bp omitted]tgctcttcagatgatttatgtctacagtatctgtagagttgaaatactgtataatagtgtgcaattgtgtctcttcccaacatcacattgaagttaactgcttgaaatcagccacagtgggaacacttacaactcagaaatcagcaaatgctataaatcaggcttgatctattcttttgttgtctatctagaggaaagaaagcaatagaaacaatgttaataatgcagataaaactcaaaggtgtgccatatctatagctgttagattgtgaataataccaaaaaatgagaaaatagtcttccagagtttgaaaaccactaacctattcagcaaggaaatcagccaggcacggtgtctcacacctgtaatcccagcactttgggaggctgaggctggcagatcacttgaggccaggagttcaagaccagtctggccaacatggccaaaccctgtctctactaaaaatacaaaaattagccaggcgtggtgctgtgcgcctgtaatcccagctactcaggacgctgaggcacgagaatcacctgaacccgggaggcagaggttgcagtgagccaagatcacactcctgcactccagcctgggcaaacagagtgagactccatttaaaaaaaaaaaaaaaaaaagaaatcactcacattgtggacaaatgaatgcagttctgacatcattgtttctcacttaaatgaaaatatcaaccaacatgcacgtcagaactacatttgttcggccgggcgtggcggctcatgcttgtaatcccagcattttgggaggccgaggcgggtggattatttgaggtcaggagttcgagactgggctggccaacatggtgaaactttgtctctactaaacatacaaaaaattagctgggcatggtggtgcacccctgtaatcccagctactcgggaggctgaggcacgagaattgcttgaacctgggaggcagaggttgcagtgagctgagatcatgctactgcactccagcctgggcgacagagtgagactctgtctcaaaataatagtaaagttctaggtaacagtagattaaatgtttatttaatccattcatccaactaatatttattgagcatctactatgtttactgagtgttgattaggtgccgacctgtaatatcagctactcgggaggctgaggcaggagaattacttgaacccaggaggcggaggttgcagtgagccgagatcgtgccactgcactccagcctgggcaacaagagcaaaactctgtctcaaaaaaaaaaaaaaaaaaaagaactacatttgttcatcaagtgcaaccacagatataagagttgggcaacaatcgatgaaagcattctgtgagaatcacttggctatattgaatttacaataaataatattgtatattttattgttatggctaattcgtgtactatatatcctttacataagtaaaatttataattaattagcttatgtacataaacacacaaaaacatacacataccttaccccaccccgagagctggtcgttaaacatttacaaactcaccactggttaagcccaaggttcacaactactttggcaccagaaacacaaggttcaaaggtcccagaggtactccaaccctgaccagaacatgatggaggacagacaacgtggctagaaaacatctatgtgttaaaaaagcaaagcaaacaaaaactttttttttgctctcactaggccataaactccatgaaggtaggaacttcatctctgccattcatagtggtatctttggcacctagtcagctcaatcatttttttttttttttggtgtgttttgctttgttttgtttgagatggagtctccctctgttgcccaggctggagtacagtggcctcatctcagctcaccacaacctctgcctcccggggttgaagcgattctcctgcctcagcctcccgagtagctggggttacaggcatgcgccaccatgcccagctaatttttgtattttttagtagagacgggtttcact[133 bp omitted]tgaaacagagtctcactctgttgcccaggctggagtgcagtgacgcgatcctggctcactgcaacctccgcctcccaggttcaatccattctcctgcctcagcctcctgagtaactgggattacaggcgtgcaccaccacgccaagctaatttttttttgtatttttggtagagacggggtttcg[142 bp omitted]acccaggctggagtgcagtggtgcgatctcagctcactgcaacctctgcctcccaggctccaacgatcctcccgcctcagcctcctgagtagctgggactacaggtgctcaccaccacacctggctaatttttgtatttttggtagagacggggtttcaccatgttggccaggctagtctcaaactcctgacctcaagtgatccacccacctcagcctcctgaagtactgggattacaggcgtgagccaccgcactcggcctcaatcagtttttctagaaaaaaatgaatggctcttctatgtcagctaactttggtttgacttctaacatcacccggggatggccttgagtggagagccaggcctgcattcctcagtctagaaatggccctctccacgggttccttgcttccctctcagtccagctcggcaaggactctagttccagcatgcttccttgatgcctgccaggaagagcaactgctttacttcctgaacactggcattgaattaaaacctagctggttccccagaaggtggcccaggctagctagatgcctctgccccttgttcctggatctgacaaaccaaaccactttggtctagctgccaactgtggctgtgtggacagaattaaaagaggtcatgggaggatgtaaggagagttaaagcaatgagggaagtctagaaaaataaatccaaaatgggaagtcatttgctttgggaaaaaaagcatagacctgtctccctgactagaaacctaggaggctttccagttctatcaaccacttagtagctgtagacctcggacaagtcgctttaactttctgatcctcaatctgcttacgtagaaaaagacataaaaaaggctattccagaaaatctcagttccctcaccctccagttttgctggtcttgagggcaactgctaacagactcctggaaggaatcctttttttttttttttttttttttctgagtcagagtctcactatgttccccaggccagagtgcagtggcacaatctcagctcactgcaacctccacctcccaggttcaagcgattctcatgcctcagcctccagagtagctgcgactacaggcgtgtgccatcacgcccggctaattcttgtatttttagtagagacggagtttcaccttgttggccaggctggtctccaactcctgggctcacgtgatccgcctgcctcagccttccaaagtgttgggatttacaggcgtgagccaccacacccggccgggaattcttacataccagaagaagggcattatttcttctggtatatatactttctttgggaaaggtgtgttttgtggcaagtggggaaggggttgtttgttgattggtttattttttagagatgggatctcactatgtcacccaggttgacctcgaacttctgggctcaaataatcctccgccctcagcctcctgagtatctaggactataggcatgcaccaccacacctagcttggacaggtgtgtttttattttctttttttttcaccttttttattgttttaattttttttatttcaatggcttttggcgtacaagtggtttttggttacatggatggattatatagtggtgaattctgagattttagtgcacccatcacccaagtagtatacattgtatccattttacagttttttatccttcacccactcccaccctcccctttctgagtctctagtgtccatcataccactccacatgcctttgtgtactgatagcttagctctcacttctgagtgagaacatacagtatttggttttccattcctgagttacttcacttagaataacagcctccagctccatccaagttgccgaaaaagacattatttcattctttttctttttctttttttttctttttttgtttggagatggagttttgctcttgtcacccaggttggagtgcaatggctcgatctcagctcactgcaacctccgcctcccgggttcaagtgattctcctgtgtcagcctcccaagtagctgggattacaggtgcttgccaccacgcctggctaatttttgtatcattagtagagatggggtttcaccacgttggccaggctggtcttgtattcctgacctcaggtgatccgcacacctcagcctcaggagaatcgcttgaacccgggaggcagaggttgcagtgagccgagatcatgccactgcactccagcctggagggcaagagcaaaactctgtctcaataataataataataataatggccattctggctggggtaaggtggtatctcattatggttttaatttgtatttccctgatgattagtgatgttgagcattttttatgtgtgtgttggccgtttgtatatcttcttttgagaaatgtctcttcgtgtcatttgccccctttttaatgggattatttgtttatttgttttcttgctgatttgtttgagttccttgtagattctgtatattactcctttgttggacgcatagtttgcaaatattttcttccattctgtgggttctgtttactctgatgattttttcttttgctgtgcaagaagcttttcagtttaattaggtcccatttatttttgtttttgtggcatttgcttttcgggtcttagtcataaattctttgcctgcctaggcaaagaatgtccagaagagtttttcctaggttttcttctagaatttttatgatttcaggtcttagatttaagtctttgatccatctcaagttgatttttgcataaggtgagagatagggatacagtttcattcttctacatggggctagccagtttgcccagcaccatttattgaatagggtatcctttccccaacttacgttttcgtatgctttgtcaaatatcagttgtttgtaagtatttggctttatttctgggttctctattctgttccattggtctaatataactacttttattttattttatttttattatttgagacagtctctccctgttgcccaggctggagtgcagtggcgtgatcttgacctaccgcaatctctgcctcccaggctcaagtgattctcctgcctcagcctcctgagtagctaggattacaggcacgcaccaccatgcctggctaattttcgtactttcagtagagatgaggtttcaccatgttggccagcctagtctcgaactcctgacctcaggtgatccacaagcctcggcctcccaaagtgctgggattacaaatgtgagccaccgcgcccagttaatgtaactacttttatatcagtactattttgttttggtaactatagccttgtagtataatttgaagtccggtaatgtgatacctccagatttgttctttttgcttaggattgctttggctattctggctcttttttagttccatatgaattttaggattttttctgattctgtgaaaaatgatgttggtattttgataggaattgcactgaatctgtagattgctttgggcagtatggtcattttcacgatattgattctacccatccatgagcatagaatgtgtttccatttgtttgtgtcatctatgatttctttcagcagtgttttgtagttctccttgtagagctcttccagagaggtatgtttttaataaaataacttatctttaaatggaagcgaaaacgtgtggaaaacatcccaattggtgaggcagggtgaaaagaaatactgcaatttctgaaagctttggataaactcacacctgatagtttaccaaaggactcaaagatgacatttgggtcttcatgttccatgatgaccttgtctgagtcagaggaatccatggctcagccacagggtggcattttatgttcttgtgttctcacatccttcaaacatcctcactgctgcatatgcacgcccacaccttcttcccacatcccgaaaccactgcccgaagacaggccaggtgatcggcaaaatgaagcccctcagcttccagtgagcagacagaaggcttcttctcagcccctccttccccttgctgcttcccaggggagaggcagactgtggccctatgattttaggagcagtccctgtccccagttgcaatatgggttcaactcccgactatttattagtcttaggcctcttgctctgccctattttatgatgttcagaacaactctatgaaaatgataaggctggcatttttcaatcctgcctcta[132 bp omitted]agctatgattgtgccattgcactcagcctgggcaacagtgagaccctgcctgagaaagaaaaaaaaaaagtagtgtttttttcttactacttctcttttcagaatgctttcaactgcctgctattttgagtccaaattcgtggcatgaccttcaaaaacaagttatcattaattcagcacttactatgtgccaggcgttgaatctcttgtatcccctgaacctagtaacaactgtaggacaggcatgccactatctttcaaatgagtgaataaatcctcagaacagccagaaaagcaggtattattattccccattctattaatgaggagactgaggcctagagaagttaagccacttgcctgaggtcacagttaataagaagaaaaatcaagattcaaacccaggtctgtctgattctaaatcttggggatgctatatatatatataaaaatatatatatttctatatatagaaatatatatatagaaatatatagaaatatatatatcttattattttattttattttgagatggagtcttgctctgtcacccaggctggagtgcagtggcatgacctctgctcactgcaacctctgcctcccgggttcaagtgattttcgtgcctcagcctccccagtagctggaactacaggcgtgcatcaccacacacagctaatttttgtcttttttggtagacacggggttccaccatgttgcctaggctggtctcaaactcctggcctcaagtgatccacccacttcggcctcccaaagtgtggggattacaggcgtgagccacagtgcccggcaatatatggctttttaagtctcctccaccctcagcctccagagagcagacagacaggaacgttctggcctagcagacagccgtgtgatatttttggttccagttattaccgtggagatggttgcagctttctaggcagatggaagcacgccagctgccccatctacagacaccgccctccacaaatagcttatcaaaccctgaggattgcaatataataaagcagctgcccctgggaactcccacagccctcccaggatacacaccgttggccagccccaaccgctggtccacccctggaagaaggacttcttggaaaacctgttgttagaaggatttccttctaggtagctgctgtgcagccagtaaccagggctgctctcagggaggatggctccacctttcattgtgcgggcctccctgtagccagctctgctcctgtggaacctactgacctcttgtgggcagagtgtaaatgcactgcagctggacagcctcagagggtgcgggcttcagccagctcctcagtttgatttgtctctgacaatgctggagtgtgctggtctcttgacctcgctgcgccttggtttcctcacctataca[133 bp omitted]ctcccagattcaagcaattctcctgcctcagcctcctgagtagctgggattacaggcacgtgccaccacgcctggctaatttttgtatttttagtagagatggggtttcaccatgttggtctggctggtttcaaactcctgacttcgtgatccgcccgcctcggcctgccaaagtgctgggattacaggtgtgagccaccgcgcccggccgagaaaaggctttaattggggggaaatatatgggtaaattcaagatgccaaggtcccaggtgggcactcacaaaattgcagtacctgaccagaatgattagatattatccaacagtgctcattaacctttttaagtctgcagcagacacagaaaatggtatttgtgttgcacaaagaaggaggcttcttgtggccagagctgccccaggctcagcccagctaccccaaaggctgagagcagcaacatctcaggattcctggaatctttttgcagcacgtggggttgacagatgtgactgtattatacaagcagttgcagaagcagtgagcattgtcaggattctctttctcctctttccatataagtcagttaacaaaacgtttgggtgggtggccctacctcttagacacccacagagtccatagacacaggtagaaaccatcattgcacagttgggcaagggtcttatatgcctggcccaggcacaaggcagggttccacaggctctggatcctttgtgcttcttttgtaatgcagagaaattaagagatcacagcagattgtgttttgggataatctgggtctgtcagataccaaagagcctcctgtctcccgtcaaacctcgtttccttttctcctgctgtctacttgcactccactgactcattcatccaacaagcacttaataagtggcaaccaagcaccaaaccttgtgccaggtcgtgggattacaggatgaaactgttgccttcaaggaactcagtctcatagaaagacagacacagaaagagaggcactggataggctgcaagagatccagtggatgtctgtaaagaggagaggaagtgcgagggcctaagtcaacctcagagagtcagggacacttgtaaagacacctgaagattaaataaggggtgggggagggaagagtaaccagggaggaacaaggcagctttgcagagagaagaacatatgcaaaggaggccccaagacatgacaaaatgaagcatgttcaaagcacttcaagtagcccagttgtgctagaatataaagtgctagatggggcgggggcgatggaaccagacaggcaagggccacatgagaggggtgccaattgaaggggtttttattcaatacttcatcatttattaaatagttcagccacaggcacggtggcttacgcctgtaatcccagcactttgggaggctgaggtgagtggatcgtctgaggccaggagtttgagagcagcctggtcaacatggcgaaacgcctctctacaaatatacaaaaattagccgggcgtggtggtaggctcctgtcgtcccagctactctggtggctgaggcatgtgaatcgcctgaacccaggacacagaggttgcagtgagccaagatcgcaccactgcactccagcctgggcaacaaagtgagactccgtctcaaaaataaatagataaataaataaataaaggcaacagggggccactggggcatcttaaacagaagaatgccatgatccaaattacatttttttttgagatggagtcttgctatgttgctcaggtcagccttggcatcctgggctcaagatatcctcctgcctcagcctcctgagtagctggaactacaggcacgtgccaccaaattactttggttgttgggaagtaagtaagaagggagagagattgtgctgagagaaatctgttttctggcttgagtaaccagatacacagtagcattcactgaatccgggaacacagggaggacccagtttgaagcagggaatgaagacaagagccattgtgaatacactgggtttgagatacctgtaagacacgaacgtagggtgtctaatagtcggatataaaagtgtttcatgggtagggcacagtggctcacacctgtaatcccagtgcattgggaggcagagcggggaggattgcctgaagccggaaatttggggctgtagcaggcaatgatcacaccattacactccagcctctgtgctccaagctgggtgacagagcaagaccctgtctcaaataaataaataaagtaagtaaaataaaaaaataaagtgggtgagggccagatgcagtggctcacgcctgtaatcccagcacttggggaggcccaggcgggtggatcacttgaggtcaggagttcgagaccagcctggccaacatggcgaaaccccgtctctaccaaaaaatacaaaaattagccaggcgtggtgatggacacctgtagtcacagctactcaggagggtgaggcaggagaagcacttgaacccaggaggcggaggctgcaatgagccgagattgcaccactgcactccagcgtggacaatagagtgaggaaacaagaaaaaaagaaagaaagaaagaaagaaagagggggagagagagggagggagggaggaagggagggaggaaggaaggaaggaaggaaaagaaagaaaagaaagtgggagagggccaagtgtcctagaaatgaagggaagaggggatggccatcggagccacactcacatagaagtcaaataagacagggctgaaaaaggagaaccatttcagcagtgatggagaccgaagcaagatcacagtaggcctcttcaagaagcttagactgtgaaggggaggaaagaatgaaagctagaagtaggctctgtgtcaaaggtttttgttgaaggcattagttcaaatgtacatgctgaggaggagagatggagaaagaggggaaggttgaggcttcaggaaagagaggaggtaagtaatagagcaaagtccaaggggaagtgaggaggactgaactgaatacatgggggaggtgggtgtcagcctggggcaggaggagggagttaggggagggggagagggtggtgcaggttggatttgctgagcagactctgagatggagattagcatgcaggaggtttcttagggagtactcttgggatcatcacgcgtggaaaggaaggaatggaagcaggactggagaaaggagacattgggctgcaatgcagattcaacaaaggcctcagccagacctatgggaagctctgaagctaagagtggagacaagggggccaggcctttatatccccacatcagtcattcattggacacaggctgtcctgggaaggaggcatgcccttgggcaaagtgggtttcttcagctgaggctgtccccaaaggggtccaccagctgagggctctctactgttaggcactgagtctttctgttgtgaagatcagggaagcacattgcagtgtctcctatagagaggaagggggcgctattgcatttgagttgaatctgcagcccagttggtgtgaggctgaagttcacgctgttggcttcaattttgctccgtgaagatggaaaccaatctttctgatgaaaagggggctagctggggttgggggctagaggagagtgaaatgatgatgaaatggctgcttcaggacactgaagatgcgctgaccagggacatacaataggattgccaagcgatgttagggtcttagttgaaactaaaaaaatcattttagcaggcccaaacagtgtcgcgatttcaaggctctgtcattcttggtcacttggatatctgtccttcctcctatggatttttgttagtttttatgaggaaatgtctatattatttagaggagaatattttgtgagaccgtgttcctaaattctgcaactttttacctaaactacttcctgaaccaggcctaaattcaaggccttcagtatataattacaattttcgctacaacaatcgttgctgatgctaatgatgacaatcttgctagtggcaaacaaaactgtgtggatattaaaatattataaaccaattagaaaatgacttcaggcctgacaataaagaagataaacacttgtctacaagtagacaaataaaaatcaggattaaatctaattagcaggcaaatacaaaatgtagaaaattacaaaggaaaacgaaatttgaagcttcaaggaaaaaaaacactgctataataacgaaatatagaacaggtggttcatcaggtactagagtgacaatagacaagtacaccgtccaattaaacaatcggcttttaaaatccatacaggaattatgtggatgatcattcaaaaacaatgtctcactgttctgtgaagaaagggtcccccacatgagggggagcagttataatgagaattcactaggcctaaagtgtaggctaggtaaccaaccgtgccttgctcacgaaaccagcttgttattccagagtaactatgagcaagcaacaaccatgttcatagtagcagtagcaatacggttctttcgttttgtttttttttgagacggagtttcacctcttgccgcccaggctggagtgcaatggtgcgatcttggctcactgcaacctccgcctcctgggttcaagtgattcttgtgcctcagcctcctgagaagccaggattacaggcgcctgccaccacgcccagctactttttgtatttttagtagagacagggtttaccgtgttggctgggcttgtctcgaactcctgacctcaggtgatccgcctgcctcagcctcccaaagtgctgggattacaggaatgagccaccacgcccggccagcaatacagttcttaggggaaaaaatgaaatgtccagttcaagaataaaatcaacattcatgatggggcctcactcggcctccctgcacagatttgtcaccgaacatacatttcaacaaaggctttggtgcccaagtgacttcaattgtagaaattttaggacataaaggatggaagacctatagggaaactctttaggaggaattaaccaggtgtaccttaaaatcactctagggccgggtgcagtggctcacgcctataattccagcactttgggaggccgacatgggtggatcacttgaggccaggagttcgagaccagcctggccaacatggcgaaactccatctctactaaaaatacaaaaattagccaggcgtggtggtgcacccctgtaatcccagctactcgggaggctgaggtgggagtatcgcttgaacccaggaggcagaggttgcagtgagtcaaaatcatgctactaattaggagatatacctaatgtaaatgacgagttaatgggtgcagcacaccaacatggcacatgtatacatatgtaacaaacctgcatgctgtgcacatgtaccctagaacttaaagtataataataaaaaaaaaatcatgctactgcactccagcctggactacagagtgagactctgtctcaaaaaaaaataaaaatcactctagatatgaggggagtcggtactctttccagcccaactttagagaacagctggagatacccacagcctccaacggtggaacacttccagcaagtataatcttacagctcttttctaccagcctgcctgaccacgaggcactaatcccaggagctccaactactgttccccagtcctttaccccctatctcagaaagacacacatgtactgtcaacttaaataacagaaagagactctctaatagaaaatgacatttattcgggaatagggcattgcaatgggaataataacaccatagtaaactatgtgcatattcagggaggtaaaggaagacaaaggcttttaaaggaaaaatgggccaggcgtgatggctcacgcctgtaatcccaacactttgggaggccgaggcgggcagatcacctgaggtcaggagttctagaccagcctgaccaacatggagaaatcccgtctctactaaaaatacaaaattagctgggcatggtggcgcatgcctgtaatcccagctacttgggaggctgaggcaggagaatcgcttgaacctgggaggtggaggttgcggtgagccaagatcacgccattgcactccagcctgggcaacaagagcgaaactccatctcaaaaaaaaaaaaggaaaaatgaggattatataattgtttttgaaatgattatccttggctacaaagatcaataacaagggtgatgccagtctgaggctggacaggcagttgctgggcagatgtccttgcagaagtttttttttgttattttgtgtgtgtgtgtctgtgtgtgtgtgtgtgttttttttttttttttttttttttgagatggagttttgctcttgttgcccaggctggagtgcaatggcatgatctcggcttgctgcaacctccgcctcccggttcaagtgattctcctgcctcagcctcccaagtagctgggattacagctgcccgccaccacgcctggctaattttgtatttttagtagagatggggtttctccatgttggtcaggctggtcttgaactcccgacctcaggtgatccacctgcctagctctcctaaaatgctgggattacacgcgtgagccactgcgcccggccagaagtattttttgtgtaaggttgcaatggccattgtgcaaggttgtggtttttgtggagttttttgtgatagtcttgttatcatacaagtgtgagaatcctctcttacatagccttgcctagctctatgtgtcagggctttttaaaaaatataaaagtgactccattttgattctgacaactttcacagtacacatgcacagaaaaagtattgatgatcttggtgatcttctgaatctccaaggatacctaccttaccatgttccagacaatctactaagggctttgtgctcatattacccctttcttcctctcaagaactctataaagcaggtacttctattatccccattttatagatgaggacatggatgcacaaagaggtaacatgacttacttaagatctcagccagtaagtgacagagccaggacacaaacctaggcgatctgatagtaaggctgtacatttcccctaatgctatgatgcctcccacattttgaggactagaccagtgattcctaaccattcttttttcattggtccctctgaaaattgggtgaaatcaacaaatcctctccccagaaaaatgcccatctgttcacaagcacacagaacatatttaatttcaaggagcttggggactccctgaagctcatccctgaagcccatggagcccaggttaagagcttctattgtgtaggctagcacgctctcgggaagcaatttggcctagaccccacccaactcatcataccccttgcttcccctgggagagctcaccccctgtgctttaggctactctcacagctgaagttcagaatgctctagggctttgtaacctggctttgtaacctgacacttgtgacctcatatttgtcccaacatactatgtccatgccatctcctgctgcaccaggatgaggtctctactgggctagcccagccctggtccagagaagataagctcaaagattgttcacaaagagagcagggcatagtgcttcaactccagaaacagggagggaaatcaagttccctggcagagcaaataaaaactggtgatgcccaaaagccaagacttggaagcaacctaagtgtccatcaacaggcaaatggataaagaaaatgtggtacatacacacaatggagcactattcagccataaaagagtgagatcctgtcatttcaataacatgatagaactggagggcattatgttaagtgatataagccaggcacagaaagacaaactttacatgttctcacttatttgtgggagctagaaatgaattcatggagagagagagagtagcaggatagttaccagaggctgggaatggtagtggggagttgtggggggggaagtgtggatggttaatgggtacaaaaaatagaataagatctagtatttgatagcacaacagtgtgactatagccaatcatttaattgtacattttaaaataactaaaagagtgtcattagattgtttgtaatacaaggataaacgcttgaggtgacggataccccatttaccctgatgtgatttttacacattgtatacctatatcaaaatatcccatatgccccataaatatatacacctactatgcacccacaaaaataaaaagaaaactggtgatgccaagggctccccaaacaatggccagaactggaagtacagtcaggaaaggatacaagtggacacaggtggaaacctgctctgggggcatctagggtgggtgctgtggtttggcctccccaaccagacattcagatttgagctgctccagagcgctcagcaggaaagacatgtgagattcacatttgaactcagaataggtcggggaaaaccacatttgcggttcattcattctgtcaacagatggtatttagcatttgttttttgttgttggtttttttttgttttgttttgttttttgagacggagtctcactctgttgcccaggctggagtgcaggggcatgatctcggctcaccacagcctccacctcccagattcaagcgattctcctgcctcagcctcctgagtagctgggactacagatgtgcgccaccatgcctggctaatttttgtatttttagtagagatggggtttcactatgttggccgtgctggtctcgaactcctgaccttgtgatccacccacctcggcctcccaaagtgctgggattacagccgtaagccactgcgcctggcctgtttttcgttgttattgttgtttttgagaccaagtctcattctgttgcccaggctggagtgcagaggtatgatcttgtctcactacaacctctgcctcccgggttcaagcgattctcgtgcctc[134 bp omitted]tggcctcccaaagtgctgggatttataggcgtaagccaccgcgcccggacggtatttagcatttgtttccttaccaagcagttatctgccaggcactgtactaagttagcactttacaaatatcaactcacttaattttcacaaaaccataatgagatgagtactactattgtccccattttagacacaggaaacctgaagcacaagagagattaagcgacttggccagttacacagctagtaagtgacagagccaggacgcaaatctaggcgatctgatagtaaggatgtacatttcccataatgctatgatgcctcccacattttcaggaccagatctgtgattcctaaccattcttttttcatcagcagagctgggactcaaactcaggcagtcaggcctgcagcacccatgctctgaaccaccgtcttctgcagctagtgtgatccagaggcttggctagttactggcaatagagcagtgaacaggccagacatgatctctgccttcaaggtgtttacattctagagtggcccctgagtagtcaacaggcaattccatcaagttatgatgagttccatgttgggggtccgggaggctgtgagtgggctccatattgggctgggttctgggcttcagagcagaagccaacaggttgtagggacacctttcttgggttcaggatcaaagaggccaaacaggagtaggggagccatttctgattgtggggcctgcctttcagctcccattctgaagctgggaaaccaaacagctgtgagtgagtctcacatcaggaacagaagcagcacaggaaccaaacaagcgtggtcactcccgccaggggtatcagaacagcagatcctacagacctgtttcctcatcaatctctcctcgcagagactacaagctccctgagggtaagacctaggcctgcctttctccctcattctctcagtgcccagcacaaggttggcacctaatcaacactcagtaaacacagtagatgctcaataaatattacttggatgaatggattaaataaacatttaatctactgttacccagaactttactcttattattattttttatttatttattttttaagacagaatctcgttctgtcgcccaggctggagtgcagtagcatgatctcggctcactgcaacctctgcctcccaggttcaagtgattatcgtgcctcagcctcctgggtagctgggactacaagcatgtgccaccacacctggctaattttttgtatgtttagtaga[141 bp omitted]gcagtgaacaacaacagaaaaaatccctgtccccactaaacttttagcttatagtgggagcaccagacaatgagcaaaatgagcaaatatttatatagggttttagcgaaaaactataggaggagagggggataggaagtatgaggaggcgatgaaattttagatacaatggtcagcaaaatcctctgagaaaatgacattttctcagacaaaatcaagacctgaaggaagtgagggtgggccgtttgcagatacctgaggaaaaaatgtcaaggcaggaatgtgcctggcatgtctgagggccagggaggagatcactgtggctggagcagagtgagctgatagggactggagtaggagttgaggtcagaatgaatgaacaagtggagactgggaatggtaccaagaagcaggggaaccaaaccagttccacagccagaagccctccaagtcctgactggccccatggggaaagggagaggagagcccccacaagagtgcctattaactcacactcctccagctccattccaaaggcatgacttgagtccctaccccatgcccagccctgaaactcctggaaaaaaagcaggatattccttgaacctcctctttctcctcaattgggaataagggctgagctggcaggaacaagctgagattgagaattgacctgtagagcttacacagtccacccttcctccagaatattccatttgtccttggagacagcatgacggagccatgatgggctctggccatctgttccctctggtccttctgaaagaaaacactttcagaccaggcaccgtggctcatgcctgtaatcccagcactgtgggaggctgaggagggaggatcatttgaggcctggagtttaagaccagcatgggcaacatggagaaaccctgtccctacaaaaaaaaaagaaaaaaaaatatatatatatatatactctctctatatagtatatatataaggttggtgcaaaagtaattgcagtttttgtaacgtgatggcaaaagccacaattacttttgcaccaacttaatataaatatagttatatatataatgcttatacttaaatatataaaagccagacgtggtggcacatgcctgttgtcccagctacttcggaggctgaggttggaaggaacacgagcccaggaggtggaggctgccgtaagccagcatcacaccactgtaccctagtgtgggcaacagagtgagaccttgtctcaaaaacaaaaacaaaaacaaaaaacacttccaattagagtctttagacagcacatttctttgaaagttccacttttccaccctcctccctcactctggccccaccaccagaggcaaaaagagtcactggcactgccctccttttgggatccctgtgtccaaggaggtgggcctgcactgtccccaaagagttccaaggtcaaaccctccattatctaaaaaatggtttgggccgagcacggtggctcatgcctgtaatcccagcactttcggaggccgaggtgggcagatcgcctgaggtcaggaattcaagaccagcctggccaacatggtgaaattccatctctactaaaaatacatcattagccaggcgtggtggtgggcatctgtagtcccagctacttgggaggctgaggcaggagaatcgcttgaatctgggcagcagaggctgcagtgagctgagatcgcgccactgcgctccagcctgggcgacagagcgagactccatctcaattaaaaaaaaaaaaaaaagaatggttagaaggaactctttagacactttggacacaagcccttcacgatttttgtcttacaagtatgttcaccttctctgtagcttttctaccctcgatagcatcttttgatgagcaggtgcttttttttttttttttttttttgagagggagtctcgctctgttgcccaggctggagtgcagtggcaccatctcggctcactgcaatctccgcctcctgggttcaagcgattctctgcctcagcctcccgagtagctgggactacaggcgcccgccaccatgcccggctaatttttgtttttgttgttgtttttgttttttttttcttttagtacagatggtgtttcaccatcttggccaggctggtcttgaactcctgacctcacgatccacccgcctcaggctcccaaagtgctgggattacagacatgagccaccgtgcctagcctgagcaggtgctcttacactgaatgcggtatccatcttttctttcatggttagtggttttgtcttaagaggtctttcatttcccagagataatgaaaatgtttttattattttctagaagttttaccactttgctttttacatttagatctcatttacctggaattgacttttgtggatgatgagaggtagggggtcaagttttctttttgccatgggaatagacaattgtcttagcaaaatttattacaaaaaaattctttccggccgggcgtggtggctcacacctgtaatcccagcactttgaaggctgaagcgggtggatcacctgaggtcagaagttcgagaccagcctaaccaacatggtgaaaccctgtctctactaaaaatacaaaaattagccaggtgtggtagtgcgcgcctgtaatcccagctactcaggagactgaggcacgagaatcgcttgaacctgggaggcaaaggttgcagtgagccgagaccgcgccattgcactccagcctgagtgacaagagcaaaactccatctcgaaaaaaaagaaaaaagaaaagaaaaaaattatttcctcactgaatagcaggggcgcctttgctgtacatctagtgactgcacatgtgagcctgtttctggactctctattgtttcattgatctattgtccatcactgggccaataccatactgtttaaattactttcaatatataataaaacaatatctagtagaacaagtcctatcaccttgttcttcaagagtgatattggaccttttcattctgtataaatttcactcctattcttggactttctccttgctttataaatttaaattagcttgtcaagtctcccctgccccctgcccagcaccacgtggacatatgcacacgtggacacacacacacaattgttgagatttttattgtggtctcactgaatctataaatcagtttgtggagaactgacactttaaagctattgagtcttccacatgaacacagtgtatcattccatttactcaggttttaatttttctcaacgatattttatagtcttctatgtaaaggcctgcataatacttccttagatttatcctcaggtatctttatgctattttaatcatttaatatgtctaattttaaatgttacgtttccaactgctggttacttagatacagaatacaattggttttctatattaaccgcatgtccagcaacttctttttttttgagacggagtcttgctctgtcacccaggctggagtgcagtggtgcaatctcggctcactgcaacctccgcctcctgggttcaagcgattctcctgcctcagccttccgagtagctgggactacagatgcacactaccacacccagcaaatttctgtatttttagtagagatgaggtttagtagtggccaggcggtctcgaactcctgacctcgtgatccacccacctcggcttcccaactgctgggattacaggcgtgagccaccgcaactggccaacttttctaaattcatttatcaattcaaatatttattcttcagttattttggatattctatatacacaatcatgttttctacaaataatgatgttgttatttcttccaagtctttaaacgttttgtttccttttcttctcattgcactggctaggattcccagtaccatggtaataaagggaatctttgtctcatttccaacttcaggaggcaagcttttaagtatgcttgctgtaggattttttaatagatgccattaatcataatttaaaagttttcttctattcctagttcatttccatgtgtatccttacaattaatccctctcattttctaacattcaaaagagcctaattaaaacaatgataaatgtgtcactttcttttaaatattaatacctcatatatttttcttaaaaaaaaactttttaaaactagagacagggtctcaccatgttgcctaggctgctctcgaactcctgggctcaagcgatcctcctgccttggcctcccaaagtgctagaattacaggtatgaaccaccctgcctggctcccacatttttcttaatttttaattgacacataataactgtacatattatgggatacaatgtgatgttctgatacatgtatacaatgtgtaatgatcaaatcagggtaattaacatatccatcacctcaaatatttatcatttgtatgtgataacactcaaaatcctttcttgtattttgaaatatacattattgttaacaataatcatcctattgtgtaacagaacatcagaacttattcctcctaattgtaactttgtacctattgaccaatctctgccatccctccttccccctccccaggctatagtaaccactgttctatcctctacttctataaaatcaacttttttttacattcaatatgagtgagattatggggtatttccctttctgcgtctggctaatttcacttaacataatgtcctctaggttcatccatgttgttacaaatgatgggatttcatttctttttatggctgaataatattccatcgtgtatatgtatatatatgcgcgtgtgtatgtatgtgtatatatacacacatacacacatatatatatatgaactgggattgctgtatcatatggtagttctatttttaattttctgaggaacatcccatactgtgttccataatggctgtagcaatttacatttccaccagcagtatgtaagggttcccttttctccacatcctcgccaacccttaccttttgtctttttgataatagccattctaactaaagtgaggtgatatctccctcacatcacctcactttgatttgcattttcctgattagtgatgttcagcattttttcatatacttgttggccattctgtatgccttcttttcagaaatgtctataaaggtattttgcccgtttaaaaatcagattgaggccaggtgcggtggctcacgcctataatcccagcattttgggaggctgaggcggatggatcgtttgaggtcaggagttcaagaccatcctggccaacataccccgtctctaccaaaaatacaaaaattagccgggcattggtggtgcgcacctgtaatcccagctacttgggaggctgaggcctgagaatcacttgagcccggacggtgcaggttgtggtgagctgagatcgcaccactgcactccagtctgggtgacagagtgagaccctgtctcaaaaaaaaaaaaaaaaaaaaaatcagattaaggccgggcacggtggctcacacctgtaatcccagcactttagaaggccaaggcaggtggatcacctgagctcaggagttcaagaccagcctggccaacacggtgaaactccgtctctactaaaaatacaaaaattagctaggcatggtggcgggtgcctgtaatcccagctacttgggaggctgaggcaggagaatcgcttgaacctgggagggtgaggttgcagtgagccaagaccgtgccattgcactccagcctgggcaacaagtgcaaaactccatctcaaaaaaaaaaaaaatcggattgagtttttgctattgagtttgaattccttatacagtctggatattaaccccttgtcagatgtagaatttgcaaatattttctctcattatgtaggttatatcttcactctgtggactgtttcctttggtggacagctttttagtttgatgtaatcctacttgtctatttttgcttttgagttcatatgaaaaaaaaaaaaaaaaaaaccttgcccagcccaatgtcataaagcatttcccttttcttctagctgtttcagtttcagatcctacatttaagcctttaatccactgggttagtttttgtatatggtgagagagaggggtctggttttattcttctgcatatagatatgcagttttcccagcaacatttattgaagagactgtcctttccctaatgtgtgttattggcgcttttgttgaaaatctgttggctatagatgcgtggatttatttctgggctcactattctgtttcattgatcgatgcatcccagcaactcgggaggctgaaatatgagagtttcttcagcctgggaggcagaggttacagtgagctgagatcgcgccaatgcactccagcgtgggagacagagtaaaactgtctcaaaaaaaaaaaagcaccgattccatctggttgttttcaaaaggaaaaattaattgtatttctctgaaaatgaaaatgactgttttgggaaactctaagtttaccatccctggagactttaaagcaaaggctggaccagtatgtgtctaggaggctacacaggaaattcctgcacacaagagaaggttagagggtatgacatctaaggtcttttctaaacttcagtgatgaagatcctgtgactctgcatttctataaatcctatcattgggccaggcacagtggctcatgcctgtaatcccagcactttgggagtccaaggcagacaaatcacccgaggtcaggagtttgagaccagccaggccaacgtggtaaaactccatctctactaaaaatacaaaaattagccgggggtggtggcacgcacctgtaatcccagttacttgggagggtgaggcaggaaaatcacttgtactcaggaggcggaggttgcggtgagccgagatcgtgccaccgcactccagcctgggtgacagagtgagactccatctcaaaaaaataaataaataaatcctattattgtactgcttctgcaccagatcccattccctcctgcctactcaagtatattgcttcagttattttctctctcctgcattatcagtttttacttctctcttggatttttccttatcagcattcaaatatgctgttatttctcccatcttgaaaatactgttaatcttacttccccctccaaataccaccccctttctcttcttccctttcatagcaaaactccaaaaaaaagtacctatattcactacctccaattcctcttctttcattgtctcttgaactcagtcctgctagcctttcgcttatgccactccattcaaacaccttgtaaaagttaccaatgacctccccattgctaaatgcagtggtcatttccaagtcctcatcttgtctgtggcatttggcagatgatcatttcctcctcctttaaacacaggctggtcatttgtctatttgctctcagactcattccccgcttctcaaactcctgacctcaagtgatccacctgcctcagcctcccgaagttgctgggattacaggcgtgagccaccgtgcctggccccattccactcttcccctgctctgctatgtgcagcagacaacatttcccaggctcctttccctcctgacttcctgagaggtttggcctgtgaatgggaatctttggcagaagactggaaagcaagagaagggaagaagccagggtatttcctccctttctctctgttttgagcgtcatctccagcatagactgttatctcttctgtggctcccactagatagtcactccctccatggaccaagctcctgctgggctggtgttcctgcttctgctgggtggtccttgatcccggacttgggtaataccaccttctgcttttgtccctccagccctagaggtgaagtagcttcctgctgttgctaaatctctggatcaattcatcatcccttcctgggattctaaggtcttctatcccctgagtaccagttcctcatgttaaattctgtttacaactctgaatacgttttgttttctttttttcttttttaaaacggttgttcgctcttgttgcccaggctgaagtgcaatggtgtgatcttggctcaccacaacctccgcctctcgggttcaagcaattctcctgcctcatcctcccgagtagctgggatcacaagcatgcaccaccacgcccggctaattttgtattttcagtagagacggggtttctccacgttggtcaggctggtctcgaactcccgacctcaggtgatccacctgcctcagcctcccaaagttgttttctgttttcttaactggacctcgagtcatgtaaaacacttgcttctcttcactctcagttttactctgtcttcatccagccttagtagccattcctttgcagtcttttttgctgatttctcctcctctcttgaccattaaatgatgccccaggactcaatccttggacttattccctttgctatctgtatttagatctttggcaatttcatcctgtctcatggctttaagtaacatctatatactgacaactcccaaatttatatttctagctagaccttcccagttgagctgactacatatccaactgcctacctgacaactccacttagtcaacagacatttcaaacataacatgttcaaaatggtgcttggctttcccttgaaagctgttcttccccatctcagtaaatgacacttcaatttgcccagttattctagccacaattgaggagttatccttgattcccctcttcccctcacttctcacaccaaatctatcacccagtcctcataggaaaacctccaaaacacatctcaaatccattcactttctccaattcttcttttactaccctggtccaaccattctcacctctcacctggactaccgccatggtctcctaattggtctctctgcttccattctgcctcccaaaaagccactctccatgcagcagctagaatggctttttttttttttttttttttgagacagagccttgctctgttgcccaggctggagtgcagtggcacaatgtcggctcactgcagcctctgtctcccgggttcaagcgattctcacgcctcagctccagagtaggtgggactacatataggtgtgtgccaccacacccggctaatttttttatttttagtacaggtggggtttcaccatgttgcccaggctggtcttgaactcctgacctcaagtgatctgcctgcctcaacctcccaaagtgctgggattataagcgtgagccaccgcacccagcctcgaatgactttaaaacataaattggctgggcacggtggcatatgtctgtaatccagcactttgagaggccaaggcaggaggatcacttgagcccaggagttcaagaccagccagggcaacctagtgagaaaaaaaggacaggacaggacaggacaggacaggacaggacatgacaggaaaaagggaaggacaggaaaaagaaaaaggaaaggaaaggaggaatttctttctacaaaaaatagaaaaaattagccaggcgtggaagcacgtgcctgtagtcccagctactacttgggaggctgacgtaggaggattgcttgagcccaggaagttggggctacagtgagctatgatggtgccactgcactccagcctgggcaacagagaccctatctcaaaaaaaagaaaaaaaaaacctataaatcatatcatgttactcctctgcttaaaagccttcaatcaataacttctcactgtatttttaagaaccaaaatccttattcaggcctgcaaggccctacatggcctggtttctgctcactcctctgacctcgcctccttccacttgcttgctttctcttactcactacaacctagtcacactggccttatttctgttcctccaacatgtaaacttattccctttgtagggcctttgtcctttctaatgccatcatcacctggaacgctttcccctgatccttatatggctggctcattcagatccttcaggtcttatgtggctcagtgtcccctcctcagagcccatccttgattactcatcactcgctatcatatcacactattttcgtagataattttcttgttcacttgttcatctgtcacccctgccctcagaatgtgagctgctttgttctctactatgcccccagctcctagtgcaatatctggcatataatagatactcaatgtatactagttgaatgactaaaagtagattagccttaagtaggaagagggggatctcttcctctgagatttgaaagagaaaaagatggaggcagacacaactaagtgtgcccttaagttgctggtgctttggagatccctctctggtcatctaccaagagagagagcttgcagggagaggcttgaagaaagcagctgtaaactgttccttagggaaacaggagagttgctgacccaaaacatacattaggattgactagctgtggtaagaacccatctgacactggaaccataaattcacagtgccaaatatccactcattgacaagacatgaacactcaactatttgggtaagacatcagacaaaacatattgtaggactgattctaaattgagagtttgtaggacagatgttatagttttaaaagaaggtaagatctacaatagcaccggaaaaatgaagtacttaggtataaatttaaacaaaatatctgcaggacctatacacgaaaaaaataacaaaacactgatgaaagaaatcaaagatctaaacaaatggaaagtggaaagatacactttgctcatgggttggaagatgtaatattattaagatgtcaattctccccaacgtgatttttcgattttacacaatcccaatcaaaatcccagaaagaatactggagataccaacaagccaattctaaaatgtatactggaggccgggagcagtggctcacacctgtaatcccagcactttgggaggctgaggtgggtggatcacttgaggtcaattcgagaccagcctggccaatatggtgaaactccgtctctactaaaaatacaaaaattagccaggcgtggtagcatacacctgtagtcccagctactcaggaggctgaggcaggagaatctcttgaacctggc[139 bp omitted]gaacttgaatagacatttctctaaagatgatatacaaatggccaacaagcatatgaaaaaatgctcaacagcactaatcattagagaaatgaaaaaaaaaaaaagaacctacaatgagatatcacctcacatccattaggatgattactattaaaaaaataaaaataaaaaaataacaagtgttggtgaggatgtggagaaattagagccttggtgtattgttgataacattgtaaaatgtggccgggcgcagtgactcacgcctgtaatcccagcattctgggaggctgaggtgggcagatcacttgaggtcaggagtttcagaccagcctggccaacatggtgaaactccatctctactaaaaatacaaaaatgagctgggcatggtggcacacacctgtaatcccagctacttgggaggctgaggtgagagaatcacttgagcccaggaggcagaggttgcagtgagctgagatcgcaccactgcactccagcttgggtgacagagtgagactctgtctcaaaaacaaacaaaaaaagattgtaaaatggtacaagtgctgtggaaaacagtatgtatggaggtgcctcaaaaaattaaaaatagaactaccagcaatttcacttttgggtatatatcagaattgaaagcagggtctcagagatatttgcacactcatgttcattgtgctactattccacaatagcaaggggtggaagcaacccaaatgtccattgacggatgaatggataaacaaaatgtggtatagacatacaagggaacattactcagccttagaaaggaaggtgttcttcctttctaatgattcaacattgaggacattatgctaagtgaaataagccagtcacaaaaagttaaatgttgtatcattccacttacatgagatatctaaagtagtcaaattcataaaaacacaaagtagaatggtgttaccaggggttgtggggagagagaaagggggagttgttacttaataggtatagagtttcagatttacaacatgaaaaagttctggaaatctgtatcacaacaattcaaatata[135 bp omitted]acatggagaaacctcatctctactaaaaatacaaaaactagccgggcatagtggcaggcgcctgtaatcccagctacttgggaagctgaggcaggagaatcgcttgaacctgggaggcagaggttgcagtgagccgagattgcgccattgcactccggcctgggctatgacagcaaaactccgtctcaaaaaaaaaaaaaaaaagaaaaagaaaaaaaagaaaggttaagatggtaaactttatgtgttttttaccacagtttaaaaaaaaaaaaaaaggaaaacagtatgttccacaccatctgccattagggaaatgcaaattaaaattacaagataccatgaagaaactgttgcaaattagagaccaaggagacatgggcagagtgacatggaacctaaaatggctcaggcaacctagttttttaaaaatcttttcaatttatcttaaaaaataaagtgacatttccaaatgtcactaattaatagagaacattttgcaacattttaatgttttgtcatacttgataatttgcaaaaacaaaaacaaaaatatgataagactctccaaaatgtcaacatggctcttcataccaacagcaaaacgctgtatttcctgttaaaatacaagttaataaagaaaatagagaaactaaatactaacatatcatgttattttaataactatttaaatatgaggtgtggtggctcacacctgtaatcccagcactttgggaggctgaggcaggtggatcacaaggtcaggagatggagaccatcctggctaacacagtgaaaccccgtctctactaaaaaaaaaaatacaaaaattagccgggcatggtggcaggtgcctgcagtcccagctactcgggaggctgaggcaggagaatggcgtaaacccgggaggcggagcttgcagtgagccgagatcgtgccactgcactccagtctgggcgacagagcgagactccatctctaaaaaaaaaaaaaaaaaaaagagtaaaacataatgaaaagcatatgcttgcttggtgctaatgacgttttacagtcttatagatgaagcaacatgtgtaatttcaaccagatgttgaaatggtttaggattagtatctaaagacaagtatttcagaaaatatgtagaaaggtaaccatacacttgctacagggggtcctctatgcaactgtcttgactttgcactttatttttcaaaatgaaattataatctgttctgaataacatatatgttttaagttcatagagggagttcagcatagttaagagctcaggttttagagtcagatttttggctttattgcttactgggctataggatcttgagaaacttaaaactctctgagcctcggagtactcatttctaaaacaaggatggtaacagttaatcctgtcccgtaggatgtcgtgttgtttagattaagataatacctgtaaagtgctttccatggcatccaacacatagtaagtgctcaataaaaggtagctagtattattgttgctattcttactactattttttcattattactgttaataaaataatcacccttcaaatctaaaaacaaaataaaataggtttagaggaagtgagcacatgagagtagcaaggataggttgtggtcagagagcagagtactggatttcagaggtggagtggatgacatccaggctgtggtatgggagtttgtggctaaagtgcaggaaaggtaaaggtcactgtctggagttgaggttaaggaactgtaaggttatggtttctcatccacatgacggttaattatctctcagaatgaggacgggaaacaaggtagagaggaagaattggttgcgaagacttcactggatacaggaaaataactgggaagaaggtaacacagccccatcctgggccttcctgggacccccacccctctttttcccagttcttgctagctcacatctaacctactttgccttgcaaataaggagatcagaaaaaaagcaaaacaaacaaacaaaccaaacaaaaacaaaaacatacaaacaaaaaaaaacctgccctactatcctactatcatctcccggtagcacctcacgaacctgccttgggcacctactaagtgcaactttttgtagataatacaagaaggttaacacaactcctgtcccaacaccttttaatacagttgaatggataaaaacatggatacaaacacatggatataggtatcattgaagcagtgtgacataaaataacatctatatatacaacactcctctgcaaataacaaatgtaaagtaaaagatacccaacaaatcattttgtttatcttgctatcatttcttaatctataacgtctccctcccatgtatccatgcaaggaagcagtatcagctgcccgactagagggtagctccctcccttgggttacttttttttttttttttttttgtagagacagagtctcactctgtcgcccaggctggagtgctggagtacagtggtgcaatctcagctcactgcaacctccacctcccgagttcaagcaattctcctgcctctgcctcccaagtagccgtgactacaggggtatgccgccacacctggctaatttcttttgtattttagtagagacagggtttcaccatgttgcccaggctggtctcaaactcctgagctcaggcaatctgcccgcctctgcctcccaaactgctaggattacaggcgtgagccaccgtacccggccacccttgggttacttgagaccctactttcatttggatctgagctgtcctacccactcactgcaatctggcttttccttctttgagtataaagtcgatacgggatggctcgcctacagcttcagtgtttgaagtaaagaaagctttatgcagattctggcttttaatgggtctcctctgacagtagaaagattcaaaccacagccaattccaagaacccttctaagaacagagacagagtcacttcaaaggatctgacttgctatacctaaatataattcatggtgcttttcctatgacacaccataatattttgtccaaaaatcttgcaacatgttattaactttgaagaaagaataaaagcagccactttagagactggagacactcaagcactcatctattcataaagtttctacacagctgaagaagtttgcatcaagtggacaaaaaatagtacagaaaacctaaatacagaaaaattcagaaaactccatctcctagaaagcagggcaaggctgggcacggtggctcactcctgtaatcccagcactttgggaggcctaggtgggtggatcatttgaggtcaggagttggagaccagcctggccaacatggtggaacccgtctctactaaaaatacaaaaattagccaggcgtggtggcacatgcctgtaatcccagctactcaggaggctgaggcaggagaactgcttgaacccgggaggcggaggttgcagtgagccgagatcgcaccactgcactccatcctgggcgaaagagcaagactttatctcaaaaaaaaaaaaaaaaaaaagaaagcaagttaaatggactcagttaaagacctcactgaatgtaggagaatcaatgggaaacaacgtaaagccttctgctagggcataaataggaatccgtctatgtaatcaagaaattactttgcctcctgatctaaatgcttgcctctagtctagggcttagaaaaaggcctggttatttgaactggttgtcaatcaaggtccccttcattttcgctttcttggcttccaattcagcctagaaagaaaaaaaaagcatatgtcttgatacatgacatgaaattattttccttccttattctaaccaacccaaacactctcccttaatgttcatttagtgtacaaactagaatcatggttcccaaatcattatatacctctaacatctactttccaacctttctgatgttatagcacatacacaaaaaatgctatttgtaggcaaaatgggcaaaaagacaaggctgtggccacaggaaatcagcgcagggattccagcagccccagcgccccccacaggctgagggaaccaatactgtggcataccagtatgctattcttggcagaacaggaagaacatcattctacaacagtgctacttaaagttatatggtctatgaactatttgttattggtccacacaaaatatgtacaaaaatggatagtaagcatttagaagcttttatagcaatttgacacaatagtaatttttaaaatctgataaaaattgagacaattcatttttattgtattttataaattacaaatctgttcatggaaatttgaaaaaaggaaagcactggtctttctgcctttgaaaggttgagaagcactgttctaaacgactatggcaaggtaaagcagctcccaggacccaccacttctgtcaccaaaaactcactacagacacaaagagactggtatacctttggatgagacaccaacatagtgatatctgattttgatgaaatattttaagtaattgtcaaaaaaaaatacataggcaccatcatacacagatccatatgctctaagatgagcccatgaatagtgcagaaaaccaccagtgctttaagaagcaatgaccagccccaatcctggtactaccaaggtagccctatcatgtgccattacatcctgggacaacgtccagaaaccctgacctttaactcctgatcttggaccacaagaagcagattaaaatatcatcctggcctggcgtggtggctcacgcctgaaatcccagtactttgggagcccgaggcgggcagatcacctgaggtcaggagttcgagaccagcctggccaacatggtgaaaccccatctctactaaaaatacaaaaattagccaggtgtggtggcacgtgcctgtagtcccagctactcaggaggctgaggcaggagaatcccttgaacccgggaggcggaggttgcagtgagctgagaccacgccacggcactccagcctgggcgacaaagtgagattccagctccaaaataaataaataaataaaataaaaataaaatacagaaaataaaatatcatcctagttagggctataacaagtatcatcatttaaggcctagatcctggggtcactactacagagtagggtatactgacagtcacagaccagggttataaaactggcagccaactactctaaaacctcccaacagatttcctaaaagatttccctgcctgctgaaaggtctttcagaccaagacatccaaatgatagggccccagcaccttgctaccccttgctactcaccagctcttgcagtcgcctcttgctcatgcctttgcgctccagctgtttttcaatcactttggcattctgtgcatatgagtcagcaacttccctctgaaggaaaaaaggagcatccttaaaccggaagtctcaccaaggaataacaacaaagacgttaagtcataatgtatactactcaaatcatgaaatcatgactaaaatggcaggactctgttccttttccattctccatcttttcagtaatccaggagcacttagggtattttgtttgattgcttgtttgtttgtttgttttgagacagagactgactctgttgcccaggctggagtgcagtagcacaatcttggctcactgcaacctccacctcccgggttcaagtgattcttcagtagcatttacgttttaaccaaaacatatgtaaaacagcagatgacatcttgccatcaatatcgttatactgaagaaccataaaggtaattgctactactactgaggacagactcacaaaccacgagttgggctggaaggaaactgaaatctttcagtccagtagtttctcaaattaagagggatgagcactttgccctctaaggcatctctaaaaatagcatggaggaaaaaatcactgatctcattcaacatccaactccttcgttttcattttacagatgtccctgagatt[134 bp omitted]aagcctccacctcccgggttcaagcgattctcatgcctcagcctcccgagtagctgggattacaggcgcgcaccaacacgcccggctaattttttgtatttttagtagaaacggggtttcaccatgttggccaggctggtcttgatctcctgaccttatgatccgcccgtctcggtctcccaaactgctgggattacaggcgtgagccaccacacccagcccatagtttcttatcagcagagcagggtctaaaagtgaagtctctaatatttccactactccaaggctcccgctctagagtcccctttcctcgtacccttctccccaaattccagtttccttaagaccagagacacttacagcctcaatctcctcttcctcttcatcaatggtagacacggtgacagaactgaacttgcccatgtctttggtccgtttggtcatcatcacctggagtggcaggcaagaagaagtcagtccggttcaccaaaacaggatccatgagccgtgagtgtgtgcgcacacgcctgtgtgaggggctgtgggtattgggggaaacactacctctttgggacaggatgacctatttaaaagtgccaatgtttttatttacatatttttctaacatttgccatcaaaggctcttatttttttttaatttactttatttttttgaaatagcatctcactctgctgcccaggctggaatacagtggcacaatcatagctcactgcaacctcaaactcctgggctcaagtgatcttcctgcctcaacctcccacgtagctaggattacaggcatatgcccccacgcctggctaattttacatttttgtagagactgggtctcgcaaaaaaaaaaaaaaaaaaaaaaaaaaaagaaggacagaaggtataaaaaagcatccttaacgcttaatgtctcaggcttgtatccaactcctggcctcaggcaatcctcctgccttggcctcccaaagtgctaggattacaggcgagagacactatgcatggtccatcatgggttcttaaaatttatttttaattacttttttttttttgagatggagtctcactattgttgcccagcctgaagtgcaatggtgcaatcttggctccgtaacctctgcctcctgggttcaagcgattctcctgcctcagcctcctgagtagctgggattacaggcatgcaccaccatgcccagctaattttgtatttttagtagagacggggtttct[131 bp omitted]actgtcacccaggctggagtgcagtggcacaatcatagctgactgtaacctcaaactcctgggctaaagtgatcctcccgcctcagtctcctgaatagctagaactataggtgaataccatcacacccagccaatttacttttttttgtagagatagggtctcgccgtgctgcccaggctggtctcaaactcctggcctcaagtgatcctcccacttctgcctcccaaagtgctgggattacaggcatgagccaccatgcccagcttggaatatattttttaattagcctaattcattgtttttaattgttcaaaaaaaaatttgtaaaataacacatgatatctctccataaaaagaagaaaatttgaaggaaattaatgtgagtaaaaaccatacaatttctaaccttagtcatgaggcaactgtaggaaagagagaacacataacaggtgttacaattacatagcatctgtttatacacaaaaatggcacccgattaataaagaatgcatccatacacatgcttgaggggatgaataccccattttccatgatgtgattacacattgcatacctgtatcaaaatatctcatgtaccccataaatatgtgcatctatataccccccaaatcgtttttaacttttaaaaaataaaaataaagtataagaatatatccataaagaaaaaagaaataaaataagaaaaagacaaaaaaagaaaaagaaataaaaagaatacatccataaagagcagtttctcatcactataatcttatttcaaaacatgagctaaatctagagctatattaagcagtctctccttcaatggtaattaccttcttaggaggctcttgtttctgagtatatatgttcgttttcccaaagccctggccaaacttgactactgctccatccacaatgaaggtaacaggagcattctttggctgggattggtagaagagcggcagtccacacctgcaatgacacagtgaatttctgcgaggtctcataatccaaattcccaaaacagcaatttgcaaagtgtgcttagactctgggaatatttctgtttgtggcataaactaatgactggctcttctcagtgtctcccaaaactacctctacctgataagaatcacttaggccgggcgtggtggctcacgcctgtaatctcagcactttgggaggccgaggcaggtggatcacctgagatcaggagttcaagaccagcctggccaacatggcaaaaccccatctctactcaaaatacaaaaattagccaggcatggtggcaggtgcctgtaatcccagctactcgggaggttgacacaggagaactgcttgaacccgggaggtggaggttgcagtgagtggagatcatgccactgcactccagcctgggcaacaagagcaagactctgtctcaaaaaaaaaaattcatttttctggccagctggtcaaagatacaactttgactagcctctttggggaacatattggtatttgtgcatagttgaagtctgaaggcagttgataaggataaagacataatgggggtcggacgaggtggctcaggcctgtaatcccagcagttttggaggctgaggtgggcggatgaactcaggtcaggagttcgagaccagcctgaccaacatgttgaaaccctgtctctactaaaatacaaaaattagccaggcatggtggcatgtgcctgtaatcccagctactagagaggctgaggcaggagaatcgcttaaacccaggaggcagaggttaaggtgacctgagattgcaccactgcactccagcctgggcgacagagcaagactctgtctcaaaaaaaaaaaaaaagacataatggagagttgtatccaaataattattttcctaacacattatgcctctacttgcctatgcttggagaaacccacattgttaatacttactttgcacatttcttcctgtactgtcgttcaatgccttcaggtctgcacagaaaatggaagttaaaaagatatgaacaaatctcattatgtatcaaccttactatcccatttcttcaaacgctaagaggccctttcaaaagttttcatttgggggccgggcacggtggctcacgcctgtaatcccagcactctgggaggctgaggcgggcggatcacctgaggtcaggagttcgagaccagcctcaacatggggaaaccccgtctctactaaaaatacaaaattagccgggcgcagtggtgcatgcctataatctcagctactcgggaggctgaggcaggagaattgcttgaacctgggaggcggaggttgcggtgagccgagagcgagccattgcactccagcctgggcaacaagagtgaaactccgtctcaaaaaaaaaaaaaaaaaaaagttttcatttcataggtcaactcattggttcaacattcctcccttcctgcaacaaacatttatggagcccctgatacaggtcaggtatctccctgacaaaggaagaggaagaggaggagcagtgtagtcataatcataggtagcaatagtagttgtagtaataacaacaacaataatagcggcaaccacttataaaccctttactatgtgccaagagctattctaaagtatacatgtattaactcggctgggcacggtggctcacgcctgcaatcctagcactttgggaggcccaggtgggtggatcatttgaggtaaggagttcgagactatcctggccaacatggggaaactccgtctctactaaaaatataaaaattagctgggcgtggtggcggatgcctgtaatcccagctactcaggaggctgaggcaggagaatcacctgaacctggaaggcagaggctgcagtgagccgagttcacgccactgcactccagcctgggtgacggaacgagactccatctcaaaaaaaaaaaaaaaaagtatacatgtattaactcatttaatccttacaacaactctgtgaggtatgtcatattattattcccactttatgaatgaagaacctaggcccacagagtattacatggcttgcccaaagtcgtggagctaggaagcagaggttgaatttaagcccaggcagtcaagctcaagagcccacacaataccaccttagacaccaagtcatatacacaaggactcaattccacccacacggctgtttaacagaaacctgggactcatccttgattcttctcttcccctcatctcccacacttacttcatcagcaaattctatggatttttatctccaagaaaagaccttgaatctgtctgcttgtctccacgttcctgccactatcttagcctacaccaccattatcaactccctggacgactgtaacaaacggtcctgactggtctcttcacttcccctccccttgtttcaactttgtaataggcaatatatgcatatggtatacataagagtataaaacaaaaaatatcttccctactcatcctccacccacccagttcccttccccagaggcaaatactgtttctggtttcttctgttcatcctagagatagctgatgcatatataagcaaagaactctgactggtacataaagaaaatatttttttccttttttagacaaatgtacgctgttctctacttttgttcacttaaaaatataacttggttaaatatatatatatattccatatcaatagataaagagttacttcattctttacaaggaccgcattgtattcctttgtatagataaaccaaaatgtcttttacgtgttggacaaattcctagaagtgtgtacattttaaattctggtagatgctgccaaatttctctctatagaagttgaaccaatttagactcacactaccaatatactgagagttcctgtttccctacagtctcaccaacactggatgccgttaaattgcatcactgccattctcacatgtgaaaaatggaatcttttaatttgaatttctttttttaggagtaaagttacacatcttttcatatatttaatagtcatttgcattttctttgttttgaactgttagttcatgtcctttgtttattcagttaccttttaattttatattaaggaaacttgcaataattaaggggccttgtttattctctagtttgtcatttgtctttgactttttccaccatgtggaaattttaggtttttctgtggtcaaaccaatcttcttttctcacataataattcatacaattcaatagcaaataaataaataacctgattttttaaatgggcaatggacctgaacagacatttctccaagacatacaaatggccaacaggtatatgaaaagactaatcatcagggaaatgcaaatcaataccataatgagggccggacgtggtagctcatacctgtaatgccagcactttgggaggccgaggcgggcagattacttgaggccagcagttcaagaccagcctggccaacatggtaaaaccccatctctactaaaaatacaaaaattagctgggtgttgtgacacatgcctgtaatcccagctacttgggaggctgacacaggagaatcgcttgaacctgggaggcagaggttgcagtgagccaagattgcgtcactgcactccagcctggacaacagagcaagaccctgtctcaaacaaacaaacaaacaaacaaaaaaaccataatgagatatcctctcattccagttagaatggctgttatcaaaaagacaaggctaggtgcagtggctcacgcctgtaatcccagcactgtgggaggccgaggcaggcggatcacgaaggtcaggagatcgagaccatcctggccaacatggtgaaaccccatctctactaagatacaaaaaattagccaggcatggtggcatgcgcctgtagtcccagctactagggaggatgaggcaggggaatcacttgaacccgggaggtagagg[136 bp omitted]actgctagtgaaaatgtaaattagtacagccattatggaacacagtatgggagattcctcagaaaattatagaactaccctatgatccagcaatcccacttcttggtatatatccaaaggaaatgagttcagtatctcaaagagatatgtgcactctcatgctcattgcagcattattcacaacagccaagatatggaagcaacctaaatgtctatcaatggctaaatggataaagaaaaggtggcacgcacgcacacatgcacacacaacagaacattattcagccttatgaaaagaaggaaatcctgccatttgtgataatatggatggacttggaggacattatgctaaatgaaataagccaaacacagaaagacaaatactacatgatctcacttgtttgtggaatccaaaatagtcaaactcatagaagcagagagtagaatggtgattgccaggggctgaaggtggaggaaatgggaggttgttgtccaatggatataaagtttctgttgcgcaagatgagtaagttttggagatctaatgtacagcatcataactatagttaacaatactgtattgtacattctaaatttgttaagtatcctcactacctacacacacaaagaaaatggtaactgtgaggtgatagatacattaatgagcttaattgtggtgatcatttcacagtgtatatgtatatcaaaatatcaagctgtatcccttaaacatatacaatttttgtcaattatacctcaataaagctaaaaaaattaacacatcatattgatagaaggaaagagaaaaacataatcatttcaatagacacatagaaaaagcacttgacaaaagtcaaaaccccttcaatatactaagaatagaagggaacttcctctacctaataaagggcatctctgaaaaacccccatctgtttacccacgtcttagtgcattttctgttactgtaacataataccacagactggataatttataaataaaagagattgatttctcacagttctgaaagctgggaagcataagagcatggctccggcattgggcaagggccttcgtgctgcatcataacacggcagaagggcaagtaagtatgagaaagctcgattttaaaacaaagccgctcctgcaataacagacctactcacatgacagcaacgttaatccatgcataagagcagagcctcattaatccattcatagggcagacagattgtttccaacacatgaacttttggggaacacattcaaatcatagcaccacataaactaacatcatacttaatagtgaaagactgaaagctttccccctaaaatcaggaacaagataaagatgccactctcactacttctattcaacacctagaataaatttaacaaaagaagtgcaagaaatgtccactgaaaactaaaaagtattaccaaaagaaattaaagaagacctaaataaatgtaaacacattttgatgttcatggattggaagacttaatattgttaaggtggcaatattcctcgaatgaatttccagattcaacacaatccctttcaaaatcccagctggctttttcacagaaatttaagctgatcctaaaattaatatgcaattggaagaaatccagtagagccaaagcaatcttgaaaaaacaagaacaaagttggagaactcacacttcccaatttcaaaattgactaaaaagctatagtaataaagacagggtgatactggtataaggacagacatacaggtcaatggaatagaactgagagtctaaaataaacccatacatatatggttaactgattttcaacaagggtgccaagaccattaagggggaaaaactcagtctttttaacaaaaggtcctgggaaaactagatagccacatgcaaaaggatgaatttagccccctacctcatgctatatacaaaaattaactcaaaatgaatgaaagacctaaatgtaagaagtaaaattataaaactcttggaagaaaacatagctgcaaatcttcatatgcttggattaggcaaacatttcttcttttatttttgaaacagattcgggctgtgtcacccagtctggagtacagtggcacgatcttggctggctcactacaaactccacctaccaggttcaagcgattctctcctacctcagccccgagcagctgagactacaggtgtgcaccaccacatatggttaatttttgtgtttttagtagacatggggtttcgccatgttggccaggctagtttcaaactcctggcctcaaatgattcacccacctcggcctcccaaagtgctaggattacaagcatgagccaccacgcctggccatttcttagatatgatgcctaaagcacaagcaatggaagaaaaaaatcagatatatgggatgataaaaatttaaaacttgtgtgcttcaaagaatatcatcaaaaaagtgagaaaacaattcacaggatgaaagaaaatatttgcaaatcatatatatgataagggactagtatgcataacatagaattcttacaactcaacaacagaaagacaaatacaccaatttaaaaatgggggccaggtgcggcggctcacacctgtaatcccagcactctgggaggccaaggcaggtggatcacctgaggtcaggagctcaagaccagcctgaccaacatggtgaaaccccatctctactaaatacaaaaaattagccgggcatggtggtacgtgcctgtaatcccagctacttgggaggctgaggcaggagaatcgcttgaaccctggaggtggagattgtagtgaaccgagattgcaacactgcattccagcctgggcaacaagagcaaaactctgtctcaaaaaaaaaaaaaaaagaatttctacttcctctgtttcccctgtccttcctaaggttcccctccaacttaactggccagggcagagatgagggaggaacgaggaagcgggcaggcaggcagtacaactgaggcagatggtttattggtgaatgccagctgtttgggaaaaactctgtcaacctgggtttttcctctgatctcacaccacaacaacaaccttcaacacagaagaagacttctgtggccaaatgtgtgtgggtttttccccacactccaataaatggatgccagctaggtgtcctccaattcagttctgacactgtctactcggacacagcgtcagataccacaggttgacggcttggtccccaagaccggccactaaccagataccagtcgcaagtccaggcttccaaaactttttttttttttttttttaagactgagtctcactctgtgacccagattggagtgcagtggcacatcttggctcattgcaacctccgcctcccaggttcaagcgattctcctgcctcagcctcctgaggactacaggtgcgcaccaccacgcccagctaattttttgtatttttagtaaagatggggtttcactgtgttggtcaggatggtctcaatctccagacctcatgatccacctgcctcaggctcccaaagtgctgggattataggcataagccaccgcacctggctgcccggctaatttttgcaacttttttgtagagacagggtttcgccatgttggtcaggctggtctggaacccctaacctcaagtgatctgcccgcttcggcctcccaaagtgctaggattacaggcatgagccgccatgcctagtcaggcctccagaacttctgaccaaccagcttcaagttggggttcccacgaccccctctttgggttcgattactttgctagtgcagctcacagaactcagggaaatagttaatgtttaccagttaactacagaggatatcacaaaggatacagagaagagatgcacagggtgagctaaggggcaaggggcgtggagcttccatgccctccctggacacgccacccttcaggaacctccacatattcagccatccagaagcctcccaaaccctgtcctcctgggttgttatggaagctttgttacagaggcatgattgacaaccatgtagaaatgtgattggacaaaaagcacattatctaaatccagcaaggcctgtctgttcagacttttcttggcctctgtgcagcattcctttctctagggcagaggtgtccaatcttttgcacaatcttgcaaacatactaaaaccactgaatcatacactttaaaatggtgacttttatggtatgtagactataactcaatttaaaagaaactaaatctcggctgggtgtggtggctcacacctgtaatcccagcactttgggaggctgaggtgggcagatcacctgaggtcaggagttcaagaccagcctggccaacatggtgaaaccctgtctctacaaaaattacccaggtatgatggcgggtgcctgtaatcccagctactcaggaggctgaggtggaagaattacttgaacctgggaggcggaggttacagtgaacggagatcgcgccgttgcactccagcctatgtaacagagtgagactgtctcaaaaaaaaaaaaaaagtggaaaacagaaacgaaatctctgagggtaaagctgaggcattcgcattaaaacaaacaaacaaacaaaaaactcctccagatgattctggcacacagcaaaggttgagaatcactttgctaaggtgtacatgaaaagcagaatttataaggcacacattatatgcacctttagctatactggatgttgccaaagtactttccaaagtcattataactatttgtggtctttctggtactgtaggagacttccagttgctctttgacaacacatgggtattattttcccaattgaaggataaggaaattgggggcctaaaagattacttgcccaaagtcacaaagtggtactgcttgggatataactatacagactgtgctgaccatcatctttaatgttctgcctctccatttacaagtattacttatgtcaaaggtgctccaattcattgacatcactggaccagggcactaataatatttttggttctatataccctctctggtcccactgggactaaattcaaccccatactgaagggagagattcaccatacagagaatgaacttcccctagaatcctgaagtcggccaatcccgtaagttcaagctttcaaaacacatagaaatatcaaataaatggggccgcatatttctcaatgagttaatcttcaagtaccaatgacaaactggattttgtcaagtttataaaaatgtatctatttctaactatgtgccaagaagcaggcaagatgtctgtcctaagggtttcagaaaaataaggcagggttcctgctctcaaaaagttcatcttattgaaatagtgagactttaatgtaaatgaggtaagaatttcaagtggtatgacttaaagaagtgattaatatgagctagatgtttgggataattgaccttgattttctttcctatcctgaatctcaaggaatatatgaga[224 bp omitted]gaggcaggagaatcacttgaacccaggaggtggaggttgcagtgagccaagattgcgccactgcactccagcctgggcaacagagtgagacttcatctcaagaaaaaaaattctccattctggctgtggtagctagcctctaaggtggcccccaatgatccttgtccctggtactaacacccttgtatagtcacctcccacaatgaatagcgctgacttgtgacaccaaaaggacatcacagaaacaactgtgtgtgccttctgagtcatagccataaaacacattgcggcttttgccttgctctcctgaattacttacattatgggaagccagctgccatgtcatgaggatactcaagcagccttatggaaagatccctgtgttgagaaactgaggcttcttgccaacagttagcactcaactgcctaccatatgagacaccttggaagatgactctccagccctaatcaagatttcaggccaggcacggtggctcacacctgtaatcccagcattttgggaggacaaggcagggggattgcttgagcctaggagttcaagaacagcctgggcaacataggaagaccctgtctttacaaaaaaaaattaaaaattagccaggcatggtggcacatgcctatggtcccagctactcaggaggctgaggtgggaggatcacttgagcccaggagatcgagactgcagtgagctgtgattgtgccactgcactctagcctgcgtgacagagtgagaccctgcctcaaaaaaaaaaaaagacttcagatgactgtttacatagtcatcttcttaatcgcagcttcatgagagaccagaatcacctagctaagcttgctcttgaattcctgacccacagaaaatacataaaatgataaatgtttgttctttaaaaaaaaaaaaatcaagagagtaccagaagatgaagatggacagatcatagagcgcattcaggcttatatttttatccagccaactaggagtgttttccttgtactccacaatgatccctaaatgaaatcagatggggaggaaggaggagtccttaatggattgggctagactcctccccactcagagcagctttctgcttatcagtcttatttatacttctgggtaagaatttaattaaagaaaggatttttcatctaaaaatgtttcaaaggcattgctataagtgatgaagggtcactaacagatttgaagcaggtgactgacataatgtgtatttcagataattcaagcagtagaggatagactggaggagagcaaaactagagaccaaaagaccaggtaagaggccacttcagtagtctaagtaagtgattttgggtactgaaataacggcagtgcagcagggctgaacaggaggcagcagccacaaaagagattagaaggcagaatcgacagtacatggtgagtgactagatgtatgcaggggatgatggtgggatggtggggacagatgagacaaagagagactgactcctagatttctggctggggccactgcatgaatcctggtgtcatcataagaagaaggaaaagaaggactagcatttggctaatagtaatagagacctgactgcaatggcttcaacaaaagagcttgttctctcatgtaacatcaggaggaaggcagttctgagcactggttgagacccaaggatagcagggcaaaggctctgcaattcttgtggcctctccttcccagttccaggctggctgctagtgttccaattatcatgtccatttcccaagaagcaggatggaataaggataaagggtaaaaaaggcttgaagtcacccatcagctgacatctacttccatctcttttgcttggccaaagctaagtcatattcagaatcttagttgttggggggaaggggactggaatatgcacccta[132 bp omitted]tgaaaccccgtctctactaaaaacacaaaaaattagccgggcgtggttgcaggcacctgtagtcccagctactcaggaggctgaggcaggagaatggcctgaacccgggaggcggagcttgcagtgagctgagatcacgccactgcactccagcctgggtgacagagcgagactccgtctcaaaaaaaaaaaaaaaaagagtgtcagagtggtgctgagcgaatcgatctgtggtactgtccacagtagagaaatgataagtttggccttcatcatgttggatctgaaaagtaggacatcaggtgaagaggtagagtaggcaactggctatacagttctgggacacaggaaggcacagtaggcagatttagattttatcatcagcataaaagtgtaactaatgccatgtaaggtgacaagaatgcccaaggaaggcataaagagagtggggacaaaagcaaggtcagaaccgcatggaataccaatacttgaggggcaggcagaagaaaaagaatccaaaggattgagaaggccaaagaaggagaaggaggctcacaagagcagcttcacgtgttgaaaccctgtctctactaaaaatacaaaaattagccaggcatagtggtgcacaaccgtaatcccagctacatgggaggctgaggcaggaggatcacttgaacccaggaggcagaggttgcagtgagctgagatcgcatcactgcactccagcttgggtgacagagcgagactctatctcaaaaaaaaaaaaaaaaaagaaaagaaagaaagaaaacatgtagctagatgtcagcctatagtttttttctggttcaacactaaagtttcataagggcaggattctttgctgtttactggttgtactgggttagatagtgacccttaaaaattcacattctggccgggcacagtggctcatgcctgtgatcccagcactttgggaggccgaggtgggaggatcacttgagtccaagagtttgagaccagcctggccaacatggtgaaaccccatctctactaaaaacacaaaaactagccaggcatggtagcacacaccatctcaaaaaaaaaaaaaaaaagaaaaaagaaaaaagaaaaaaaaatccacatccatccaggaacctcagaatgtgaccttatttggaaatagtgatgttgcagacataattagttaagttaaaatgatgtcatactggaggaggatgggcccttaatccaatatgattggtgcccttataagaaaagaacaggcaaagggagaatgccatgtgatgatacaagcactgactggagtgatgcatttacaatacaagccaaggaatgccaaggattgctggtaaacgccaaaaaccaggaatgaggcaaggaaggattctcccctacaatcttgagagagagcatggacttaccaataccttgatttcagacttctagcctccacaactattaaacaacttctcttgttttaggccacccaatttgtagtactttattttttttttattttttgagacagtgtctcactctgtcgcccaggctggagtacagtggcacaatctcagctcactgcaacctctgcctccccatacaagcaattctcctatcccagcctcccgagtagctgggattacaggcacacgcgccaccatgcccaactaatttttgtatttttagtagagatggggtttcactacgttggccagcctggtctcgaactcctggtctcaagtgatccacccacctcagcctctcaaagtgttgggattacaggcgtgagccaccacacccaggctgtagtactttactatggcagctctagaaaactaatacactggcggccgggcacgatggctcacgtctgtaatcccagcactttgggaggcc[210 bp omitted]tgggtgacagagcgagactccgtctccaaaaaaaagaaaactaatacactggtatatattccagacttctaggatagtacctggaacatagtaggagctcggtaaatgaaatatttgttgcatgaatggatggattttttaattccctaggattgacctttccatgacttctagcacctgctgctgaccgtcccctagccacacccccacacacttcttgatactctctcctattttctgcatcaccaggttcttctggttctgttccaattcttttgtctgccttttaaatattcagtcctatctgcttgctccacactctgtaattttatcccttcccaggtttcaatttcccatatataccaaactcccaaatctaaaacagagctaaccacatcacacccctgcttaaaaaacagagataggccgggcgcagtggctcacccctctaatcccagcactttgggaggcagaggcaggtggatcgcctgaggccagaagttcgagaccagcctggccaacatagtgaaatcccatctctactaaaaatacaaaaaattagccaggcgtggtggcaggtgcctgaaatcccagctactcaggacgctgaggcaggagaatcgcttgaacctgggaggcggaggttgcagtgagccaagatcacaccattgcactccagcctgggcaacaagagcgaaactccgtcaaaaaaaaaaaaacggagatggctcttcattgcctacagattaaggccaaacttgtccacttcagcactttactctgtcctcaccctagtatgcatgatgccgttcctgtaaagtaacctgtgctccagtcacaaacgacaattcaggtttctaaagcacaccatgtttgatgcttttaatgcttccatattccttccacctggaatgctcttcattcccttcatctacttggtgaaatcctagttcaggctaaacacaaatgccatcatcttttgaagcctttcctggccaccattcaggacaaatgacccactcccacctgtttttcctttcgttcagaagaccagtattttttcctatcacaataggagtcattccctcaaagtcatgagctctttaatggtaaaaatcataccttattcatcttcacagatccagtacctagctcagtgcctggcacacggtatgctccacaagattacaggttgaatgaactcattcaaacctgtaaattgtaaacaaactacggctatcaaatggcaatggaggggccgggcacagtggcttatgcctgtaatcccagcactttgggaggccaaggagggagaatcacttgaggccaggagttcaagaccagcctggccgacatggtgaaactgcgtctctactaaaaatacaaaaattagctgggcgtggtggcgcacgcctgtcatcccagctactggggaggctgaggcaagagagttgcttgaatctgggaggtggaggttgcggtaagccgaggtcacaccactgcactccagcctgagcaacagagtgagtgagactccatctcaattaaaaaaaaaaagcaatggaatcacatgtgagcaccatttcaacaaagcacaataaagatattactacattaacagaagttagaaaaccaccacaaatgtcaaagtattgggaccaactgacctgttcaacaatagatgtgatatttatattattcagaaacagactccaacacaatagggaaatcctaaacagggagcatcaacctcttacctccgcagatacatagtctcctcatcttctgtgttacaaaacttatgggcatgtttggcagcatcaatcacacgggaccggtcccggggcctcatgggcaatttctctaactggcagtctgaaggaatggagagatttggtcactagagtcatggcaaaatatagcaaatgagtcactgcaaaatatcctgagaagttttgagtgggatccctagcactagaattttctactacaattactatgcttattgaaacctattattgaatgttccaactaaaaatgacttgctatcaggagaccttggtatttggacccagctctcttactaccctggtgatctttggcaaatcacttcctcctttggagacttttgcctcatttgaaagatgagttagatgatattatctcaaaagtccttcccaatactgcaattcaggtttctgtaagtatttctgtgatcatagtacacttggtttgtgttataatgcattagaatcaggagacacaatcaagcatactggaatgcctacaaggaagcactgggaaaagtgggtatgtgctaagaaaaggagagaggctgggcgtggtggcatgcacctatagtcccagctactcagaagaatgaggcagggcgattgcttgagaccaggagtgcaatgctgtagtgttccatgattgtgcctgtgaatagccactgtactcctgcctgggcaacacagcaagaccctgtctctgttttacaaaaaaaaaaaaaaaagaggccaggcgaggtggctcatgcctgtaatcccagcactttgggaggtcaagacgagcagatcacctgaggtcagtagttcaagaccagcctggcccagctacttgggaggctgaggcgagagaattgcttgaacccaggaggtggaggttgcagtgagccaatattgtgccactgcacttcagcctgggcaacagagcgagactccgtcaaaaaacaaaaaaaaaggaagagagagggtgattatatagtatgcaaatgatccatcctagttggaggaattttaatctgaaaacaatgaaaacacagtaaacaaattaggtacagttgtaaagcagattgaaaattgatataatgggccaggtgcggtggctcacgcttgtaatccagcactttgggaggctgaggtggcaggtggatcacctgaggtcagaagttcgagaccagcctggccaacatatagcgaaaccgtctctactaaaacatacaaacattagcagggcgtggtggcacacacctgtagtcccagctagttgggaagctgaggcaggagaatcgcttgaacccaggaggcagagggttgcagtgagctgggatcacaccactgcactcctgcctgagcaacagaggaaaactccgtctctcaaaagaaaaaaaaaagaaaaaaaaagaaaatttatataatgcaaattaagcacctaaaggatcacagagaaagtcaagtggtcagagtaattcaagatgaatagaggaggtgaagagaggagttagagaacactaggcagtttacatgtcagctcatttactcttcacaatgaatggttaaagtaaagatttgttgttcctattttaaagatgaaggaactgaggttaaaaagggtaagagatataccatgcatctaataagaagcagaacaagaattcagacccaactctaagtgattcaaaagcacatgctgtttccaccacacctccttaccaagaattaatttcttcgataaatacgtgagggccctctaggtagcaggcactgttctaacactgtgct[135 bp omitted]caacatggtgaaa[131 bp omitted]gaaaccctgtctctactaaaaaaatacaaaattagctgagcatggtggtgcatgcctgtaatcccagctactcgggaggctgaggcaggagaatcgcttgaacccaggagacggagggtgcagtgagccgagatggtgccactgcactccagcctgggcaacaagagcgaaactccgtctcaaaaaaaaaaaaaaaaattagccagacatggtggcaggtgcctgtaatcccagctactcaagagaatcacttgaacctgggaggcagaggttgcagtgaggtgagatcgcaccattgcactccagcctgggctacaagagctagacactgtttcaaaaaaaaaaaaaaaaagttccggccctgatgaagcttacattctagtggaagaggcaacatattttaaaataattataatatgattttgggtaatgataagtgctaaatattaagcagggtaagaggacaaagtgacagggatgctgttttagataaggtaatcagggaagggttctctaaggaaattacattttagcagagacctgaatgaagtaagggagggattgagggaaaagtttttggggcagaagaaataccaattaaaaaggcactggggggcaggaacacttttgacatgatggagaaaaagcaaaaaggccactgtggctgaagtgcgatgagcaagaggaagactgttagggaatgaagcctgagaggtagccacaggcctgatcaagggtcttggtatggatggactttggttttattctcagtgttatatgaaaccattggttttgaacaggactctggctactatgtggaaaagagtggaagcaacgagagcaagagactattgtgccaatccaggtgaaagatggtagtagcttggactacagtgttagaagtggaggtggtaggccggccgtggtggctcatgcctgtaatcccagcactttgggaggcctaggtgggtggatcacttgaggtcaggagttcaagaccagtctggccaacatggtgaaaccccatctctactaaaaatacaaaattagccgggcgtggtggcacatgcctgtaatcccagctactagggaggttgaggcaggagaatcgcttgaacctgggaggtggaagttgcagtgagccgagatcgcaccactgcactccagcctgggcaagaagagcgaaactccatctcaaaaaaaaaaagaaaaaaaaaaaaactagccgggcctggtggcgcacactacttgggaggctgaggcaggagaatcgcttgaacctgggaggcggaagttgcagtgagctgagaccgcgccacagcactccagcctgggtgacagagtgagactccctctgtctcaaaaagaaaaaggaatggaggtggtaagaagcagtcagatcctgcatacattttcacgaaagcacctgcaggatttcctgatggactggacagatgtaaggtacgtgacagacagaagtcaagactgattccaggttttggtctgagatactggatgaatagttgtactactgactgcaatagggatgactataagaggagcaattggagagggggtgtagagggtcatgaactcaattttcagcacgatatatttgagaggcccattagacattcaagtggagatgttgaataggcaattggagtctcaggagaggtgcaggttaaagatgaacatctgggagttaccagcatgtcagttgtatttaaagcttgggaatgaatgagatcacctagggggtgggtacagagtgagaacaggtgagagtactgagctatagggccttggaatgcctaaaagtctgagagagaaaagggagccagacaagg[137 bp omitted]acaaaaattagccgggcatggtggcgggcgcctgtaatcccagctactcgggaggctgaggcaggagaatcacttgaatccgggaggcagagcttgcagtgagccgagattgcaccactgcactccagcctgggcagcagagtgagactccatctgaaaaaaaaggggggggggaaatacgaggtaggaggaaaatcaagtgagtatggagtcttggaagcaaataaaaaacatgttgcaaaaggaatgaaatgattacctctgtcaaatgccactgacagaattaaaatgaacattgataactgaccactagaactgttaacatggagccaaatacggttaagatgatgaggtgggaaggaaagcctacctgaagtgaggtcaggagagaattagaagtcaggatgcagagacagccaatataggcaactcttttgagaagctttgctataaaagaagcaacgaaatggggttatagctggaggggaatacaggatcgagggagggttttattttcgtttgctgtgaggtaagagcaactgcagcatcttggtatccagcagaaaagttataaagcttctagaggcagtagtttttgaagacagtggattaagagggaaatacaatatgtttgtgtttctatttttgttctcctgaaggagtttagttttgaggaaggtctggatacagagtcacaaggctaaacaaaaagcaggaaaaaaaaaaatgccctggagtggggcggggatgcgtagggaggatttagtcggagagagaaaacccaccaatcttcgttgagaagtggctcccagatcacagccagaggaaattcgccttcaagaacccgaagtctggctccttgcagacgcccccgcagttcccggctactcacccagcactaggaccatctggccgcacaaacagtagtaaacatggaggggcttctcgccgtcgtcatattcctcccggtcccgagtgtcagagcagactactgaccgagacactactttcggcatgattcccaagagcaatctgaaaactctacgccaagaagagggtcgccccgaaatgacgtcacgagtgcgccttgcaccttttccttgtggctacgctggtcacgtgttagcagaagtcttataaacttccgggctgtcctatcaggctaagatatacgggggtgcgcctggagcctcccagaacctactttgtcttggccaagttagctgggactcctgtgatctgggagtcacttctcaatgaagattggtgggctttctcacaacacccttaatattatataaattctttacatttctataacgcatgcatttatatgtatatatacacatatgtatatataagaccagctaaataaaggactatgcattatatagtttatattatatatatatatatatatatatgatactgatttgggtgtgtttctaaatatgattgtgattttaatgactattccagatgagtacataattttttaggtatcttattttttagttgatataattcacgtaacataaaattcacccttttaaaatgtgtaattgggtgttttttagtgtattcacaaagttgtgtaaccatcaccactaattccagaacatttccatcatctcaaaaagaaatcttatacccattagtagtcaccacgacccgcacatcccccaccttcccagcccacggcaaccactaatctactttttatctctatggatttgcctattctggacatttcatataaatggaatcctacaatatgtggccatttgtctggcttctttcatttaccataatgttttcaaggttcatccatgttacagtacttctttcctttttatggttgaataatatttcatcatatggatatatcacattttgttcattcatcaattggcagacaacggggatgttttcactttttggttattatatagataatgctgctatgaacattcatgtacaagaatacttccaccgcaaatttgtgtgggaatataaatctggatttttaacttttgacagcacgagaagtgattaaagcaccttgacactgtttgtgattcaaacaatgtgggatgtcattgaatgactttactgcagtacaggtttcaggtataaacactgttttgccttgtaattttaggttaaattcattaaggaacattactaagtctatggcaaaagccattttttaaaactattcatgttcaataatagtggtcaagggtggggttcttctcatttagaaaattttctaaaattttgaattcaaattcaaattcaaattttctaaaatcttgaactcctgacctcgtgatccacccaccttggtctcccaaagtgctgggattacaggtgtgagccaccgcgcccagctgaacttcactgttgacactactgtcaagaataacacaagacagattcaagtttgtttgtttgtttgttgcaaagtacctgctgtttaataatacaattaataactacaggattttaaacaacttacattttgacaagtattgtacatttgtctaaaccttttctgctccatacatatttgtaatacatcttagcaaattatgctttagactgaattgaattagtgttttcctgacttctttg[135 bp omitted]tgcaacctccaccgcccaggttcaatcaactctcctgcctcagcctcctgagtaactgggattacaggcacatgccaccatgcctggctaatttttttttttttttttttttttgtatttttagtagaggcagggtttcaccatgttggtcaggctgatctcaaactcctcacctcaagtgatctgcccacatcggcctcccaaagtgctgagattacaggcgtgagccaccacgcccggtccaattcttcagtcactttaaagtcaacattgactccttgagtaaaaaacaacaactgagtaatattggtaaacattcatcaggagccaaggaaaaccacttgaaatcatttgctttgtttttgtttttgtttttgagacagggtcttgctctgtcacccaggctggagtgcagtggcatgatcacagctcactgcagcctcaaactcctgggctcaagtgatcctcccaccttagcctccctagtagctgggaccacacatgcacaccaccacatcggctattttttttttaatttttttgtagagacaaggtcttgctgtgttgcccagggtagtcttgaactgttgggctcaagcaatccttctgctgcaggctttcaaagtgctgagattacaggtgtgagccaccgtgccttgcccttttttgtttgtttgtttttgttttgatgttgatttcaatgtcctcaactcttagagccactgttcttgctgaaaggtgaatagtcttcacaagttttatttttcttgagcctatttctttgacttctgcagccaaacacaatttagctcagtatcagtaaatgactttccttggttggctaacaaaggagccactcagaaacttactttgactataggcttatttttattttttcctttttggggggggcgggggatggagtctcgctctctcgcccaggctggagggcggtggcgtgatctcggctcactgcaacctccacctcccaggttcaagcaattctcctgcctcagccccctgagtagctgggattacaggcatgcgccaccacactcagctactttttgtatttttggt[136 bp omitted]ctgcctcagcctcccgagtagctgggactacaggcgcccgccaccacgc[174 bp omitted]tggaactcctgacctcatgattcacacacctcagcctcccaaagtgctgggattacaggcatgagccaatgcgcctggcctattttttagttttattatgaattttgccataataagatattctacttaaaattttaaattttactagccattgctctcctctgagttgggaatattgtgatgaatgcttagtctggtaacattgatgtacattataatattattaaatcttttgacttttttcaaccgtttaagaatatagaaagccattcttagtttgtaggccatagacaaataatggcaggttagatttggctgcagtttgctgagccctggtctgatggatgtggctggtttgattgaattcccatgtacaacatggtagacatgtgtattagtttcatattactgctgtaacaagttaccacaaacttggtggcttaagacaacacaaatgtattatcttagagttttggacatcagaagtccaaaaccaatatcagtggtctaaagtcaaggtgtcagcaggtctgattgcttctgggggcttcaggcttccatcttttgcctcttccaactcctactgcagacatactttggctccttccctggtggccacatcactccaatctctgcttcagtcatcacatggcctcctctttgactcctacttcatccctcgtataaggactggtttgattgcctcaggcccacccctttaatccaggataatatccccatgtcaagattcttaatttaatcacatctgcaaagtcccttttgccatgtaaggtaacatattcaccagttacagagataaggaaatggagatctggctgggggggcggagggggcagggttgtgcattattcagcataccacaccatgcctttgttttctttgattcagtaatttagcaggtagtgaaatccttttttttttttgagacggagtctggctctgtcacccaggctggagtgtagtggcgtgatctcggctcactgcagcctctgcctcccaggttccagcgattctcctgcctc[203 bp omitted]gccttaatttccccatttccctcagctttgatattcccctccctccatcccaacctctttgtctctctctcttccccccaccacttatgtcctagaggctgaagatgaacaacatactacaagttgtcaagagcaagagcacacactttgctaactgttacttcctaaaagtaattctcttgaaatattttctgagattatttgagtcaagaaagacctttcgattttattttctgttggtgctttgttgctgtttgtactaaattttatcaacagaggtgaaaaccgtaggaaagtaaaagtcctttgccttcactggataacagaaatacaaacttacagcctgataaggcaagaaatgatctttaatttcgtctcttctcctaacccaaaatacttcaggaaaataaaaatctatttttcatgttgaaatcttcatgaatgaaatttcacaatttttttggtttttttgagacaagtcttgcatttttgcccagactgatctcaaactcctcacttcaagcgatcctcccacctccacctcccaaaatgctgggattacaggcatgagccactgtgcccagcccacttttctttaaattgaggagacttatcctttctggacccctgctcttgggtaggggtggtgcttggctgtgaagagggtatttcttcaagatgtcaaggtgaaaaaagggtagaaagaatgcttggccaaactgtgctaaagttagtatgttctagcctgataatcatcatgctggaaaacaatcttctgtattgctgcttgctatgacaaccctgcttctgctgaggaatgtgggggcacggtgttcctgcaatgcagtttcattccttagtcagagaatgctactcccatgcaggtgccagggggcttccaaccatttgggtcatgctcctgagtttttttgtttgtttgtttgtgttttgttttctgagacggagtttcgctcttgttgcccaggctggagtgcaatggtgcgatctcagctccctgtaacctccgcctcccgggttcaagcaattctcctgcttcagcctctggaatagctgggattataggcatgcaccaccatgcccggttaattttgtatttttagtagagacggggtttctccatgttggtcaggctggtctcaaactcctgacctcaggtgatccacttggcctccccaagtgctgggattgcaggcttgagccactgagcccagcccttagttttcttgaaaggaagaaagtccaagaaaggaagagaaagggggtttcaaaaaacagacaagctcacaacaaacttacatacatctatatccttcaataaatttcagacatgtatatccagtagcaggagcttctcagtccctttcatactttttagtacggtacatgccgcttcttaatagggtattttctttttctttctcttttttttttgtctggtcgtgtcgcccaggctggagtgtagtggcatgacctccgctcactgcaacctccgcctcctgggttccagcgattcttctgtctcagcctcccgagtagctcgaactacaggtcctcaccaccacgcccagctaatttttttgtatttttagtagagatggggttacctcatgttggccaggttagtcttgaactcctgacctcaggtgatctacctgcctcggcctcccaagtgctgggattataggcgtgagccaccatgcctggcctcaaaagga[137 bp omitted]gcctccagagtagctgggactacaggcgcccaccaccacgcccggagaattttttgtatttttagtggagacggggtttcaccatgttagccaggatggtcttgatctcctgacctcgtgatccacctgccttggcctcccaaagtgctgggattacaggtgtgagacaccgcgcccggccaggatattttcaatacatctctctcatgctcaaacacctataaaagctgcctaaattccccattctcgcatttgagggcatttaatcaacttctgtcaccctcacttttcctagctgaggtctcatcattccccagccaagaacctgtccattagccaagctcatctgcccacgggtttagctccatgcccttgtctgtgccattgcccccatataaactgcttaagttcttctctctcaagctccgctttcatctctgttgaaacaaaattgaaatacacccatttcaggaagcttgtcctgatcccaccagaatgacgattcctctgctgtgcaatctctcagcatctgtggtttcacacacttctacaagttgaggatctcaaatctgaaaatctaaaatccgaaatgctccaaaacctgaaacttttataatgcaaataattccaaaatctgaaaaaaaaaaaaaaaaaaaaaggaaatctgaaaccgttctggttctgctgttgctgtcgtaggcagacttctaagatgctaccctcccctgagattcttggtccttggtatatacacacactttctcccagttattaaatgaaatactaatctaggttctgcagtgaaaaaatttagcagacataataaaggtcccaacttagatgtttttaacatagggaaattatccatggggtgggcctgacataatctgataagcctttaaagtagactgtgctcttcctgaaaacaagattcaaagagtgagagggatgtggtgggagagaaattctctgttgatgactttgaagatggagtaggccacttggcaaggaatgcaggcggcctctaggagctgagagtagttcccaggtggcagctagtaaggaaatagggaccaaagtcctacaactgcaatgaactgggcttggccaacaacttgtaatttgttaagcagtgatgaaaacgaatatacttgcttttgtagatcttgcttttgttgatttcatatgtgtgtatgtgtgtgttagtagactgcaagttcttagatgagaggaaaaaaagttttttttttttaatttttgtacccccttcctactacagccataatgtgatgctattagggagacttgccttaactgatatgttggagttaatgggagatagaaatccttgaccatgaaagtacctgttgttaagcagcagctagaatcactaccattgtcaagtgcctcctgcttctcatgttagaaacaaattcctgcacatctgatatcttctggacatcttcacggggatgtctcaccagtcccatgaactcagtaagtcccacccaaaatttccttttccaaacttgtccctctctctctattctgtaattctgttaatggcaccttcaaaaccccagttatctcggggcttagagtttcagccactgttgactccttcctctctcttgccccatattcagcctgttgccaagtcctccccattcattcatatcctcgcctttattgtcactgcctgcttcagtatctcgcacctagatactgcaagagtctcctgcctgctctcttgagaccaatctctgataaggacagctctaatgatgtcacttccctgctcaatggacttccaaggaatccattagcttggcattcaaaactcttgatgacttaacccaaatctacctttctcctattttcaataatttttaaatgtgtattatgcctatcttctaagttattttgggttgacctttaaaaattatcctttaaaactgttattgcttttgcaggtccacggactgtgactcttcctgcaacctgcagcttttccacgttccttttacttcagacccactgtccttgcaactccctgcagtcggatagtctcatatcttggactcttctgaacataaatagccgcttggcttgttgaactaccaaggggaaatgtggttccagagccaaattgtgagtgcccaaaacaaaacagaacaaaacaaaaccctactccgcctgccttaagctcccattccctcccacaggacatacaacactatttcattctgccctggggtgatcattggcctaaacgttgagcgcccaatcctgcattcaatcccacagccccgccccgcccccccgtcatagtcaaggccgatttattcttttgattttccgtgattttaaccaatcactcctctccccacccctccgaccccagtctccggtgtccgaaggggttgtgcaccctagagttgccgctttttgagaaccggttttacctccgcccactccttcgtcctctagtttgggacttccaaacttctcccctctcctccccgggcatagtgcgcgctttcatgaatgatctggtcacaaaacaaacaaaaacgaatagaaaaagaaaaaaagagaaaaagaaaaaaagccgaaaacttcccagggtttgccttagaattagcaggtggggatggaccccgttccaccacgagctcctccagcgcccggggctccggcgtaccctacgcctctgcgctcgcggccccgccccgggcctcccgtggggctttaatgacataagcaactttcctcgcgcaccccccgccccgtcttggtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcggtcacatagcatttatacacacacacacacacacacacacttcagtttgaaggtgggaacaaaaacatttctgcaaactacttaatacatacttatgttgctgagccggattgctttttgatgctaccagtccacaaaatgttgtgaggtaagtcaatttcaactaagtctgtaattcatctcaagtacttagatttccccaggaaactgtggacagtcacctgaatatttttagcttcctctttacctttaccccctgggtaaatatcattactcttcagggctgcaaagaaaagaaatgacagcaggaaacagtgattgtaagggcatactactttggcgcagttaatcatttgaactgatttgtagcaaaaaactatagctagacttaattttcttctaccagattggcactagtttttttgtttgtttgttttttgtttttgtttttttgagacggagttgcgccctgtcacccaggctggagtgcgatggtgtgatctcggctcactgcaacctccgcctcccaggttcaagcgattctcctgcctcagcctcctgagtagctgggattacaggtgtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggccttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaagagtgttttaaatataaataaatcctatgatgaagagttttggatattacttgaaaaatcgattttcagtcatcaaaaataattttgaagttatatgtattttgctttcttctcaggggtcacaaactggtggccaaatggcagaaaacacctgcaggtgtgttttctttggccaacacagtattttccaaaacttgactttgtgagtgtctttaggcagaacatataccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcatagtcaaggtatctttttttttttttttttagctcagtataaactttttgtattggtttcttattgggatctcatatgtactcatttcccccctcaaacattaaggtaaaagcaaaaatactcattctgggaggggaaaagacaagacagatacttctggagagaactttttttttctttccagtcataagt[132 bp omitted]tgaaaccctgtctctgctaaaaatacaaaaagaaattagccaggcgtggtggcatgcccctgtagtcccagctgcttgggaggctgaggtaggagaatcgcttgaaccaaggaggcggaggttgcagtgagccaagatcgcgctactgcactccagcctggtgacagagtgagacttcttcctctcaaaaaaaaaaaaaaaatttaacagaatgtaaaattattaaataaagttacctcagtatacattataatcaatcaagggaatgaggttatggggggcgtgcggggggcagggataaaccaacctaggtatttatcagcaccctcagagaccaagatctaacttgttgatcctgacataccacctctttaaaagccctagctcaaaaacaaacagtaccaaactttttttttttttttttttttttttttgagacggagtctagctctgtcgcccagactggagtgcagtggtgcaattttggctcactgccacctctgcctcctgggttcaaacgattctcctgcctcagcctcctgggtagctgggattacaggcgctcgccaccatgcccagctaatttttgtatttttagtagagatggggtttcactgtgttggctaggctggtcttaaactcctcctgacctcatgatccacctgcctcggcctcccaaagtgctgggattacaagcctgagccaccgtgcccggcctagatggtattttaaatcctatgcaaagtttgggagtacagatatcctcaatcactttgattaaacaaaactactttcttctgaggagcaacccatctcatttgaaagaggcaaggacaatgactttgtaaaaactaccacctcttggtacttgtttggttgggtggatggggctaaatgaagttaagtccttatgacacatgtatctcactcatcttttaagacatggtacttgaagcctcagtatggagtacaatctgtactaattaccacattacttggattgtttcacctaggagcaatgtccttcaatttgcttaatagtttccctcaagtccatttctgcttcaaagtagaaccacattaaatttttctatttggtggattagttttacattaactttttcatcctgctatgtggctgagtgctttaaattgacactgttaatcatacctgaaacaatgtaaggcgagactcagaatggtcaggtttaataacttttttcttctgtacacctgagaaacactatacccaatctctttcacaggataatccatttaaaaccttacaacagagccaacaagctgacctcccaaaacaacatatgcatggtcaaaggcaccacaaaccattcatttgaacatttcatgctaattgcctctttctccctttaaaatttttaacaccacaggctacatgtattgataacaaagttaatgaaaacaaatttgcaatgtccctttttcaaatggcagtcaggtttgaacttttcaattctgcacgtgctgatgtggggaaggaggtatgatgaagaaccaaagctgcaattagaatcctttatttaggacccatctccagcttcaggggttactcatagcaaagagaatgcattgtatactactaaaaaagaatcccaacaaagtgcatgatattgccattcattttgcaatcaaaggggaggaaaaaaatccaaaaagtagatctgtgatactaaaagctagatataaaatggaaagaacagttagttcctcagtataaaaaacacttaatccaaataaaatttgaaattgctcatgtacctgtacagattgtataggaaggttactgggttaagaatgactacatttcaaagaaagggaaaatacagtaaccaactgaaaggggacaaaatggaacaaaatggaacaacagcaagcttgtcagcagctcattcatgccaacgccattctcaacattattttatcctcaagcaagttaagtgattttgctctaattctgtatcaatatcacagatcctaagaagttaggcaatctggcccctcaaatccagtaaccaaatttgtatctacttggtgcaattatttgggagccttcctaactgtaactaccttaatattctgttctgttggactcacctagacaaaccagattatatttaacaatcccctacctttccctgcctcaaaatcatttgggggaagaaagaaatgtaaagagagtaatcagtgaagttttcatatcccttaatcccaaagccactcttactcagagaattgaaaacaggtttttttctaactcacaaattcaaccatagcttctgaaggttggcatgaaccttgtaaattaaaaacaaaacaaaattgtagcccgggtgtagtggctcatgcctgtaatcccagcactttgggaggctgagaagggtggactgcgtaactccaggagcttgagaccagaatcccatctctactaaaaatacaaaaaattagccaggccaggcggtgcgcacctgaagtcccagctactcggaaggtggaggttgcagtgagccaagactgcgccactgcactccagactgggtaaccggagtgggaccctgtctcaaaaaacaaattgtaatcctacaaaatctataaacattttgcttagttttttttgccaatgttaatatgaagtggcaaaataaaatgtacacctcatttctcttcctaccgacattaagaaaggctatgcactgtaggaagacggttaatggaaaacaattatcacactgtttagttaccgtagatgagtaccagttacagaaatccaggtgtaaaggctaatccctttatattttttaagcattaatttaactacagtgggcagctgcttaatgtaaaatataaaaaacagggccaggcacggtggctcaagcctgtaatcccagcactttgggaggccaaggtagggagatcacctgaggtcagaacttcaagaccagcctggccaacatggtgaaatcccgtctctactaaaatacaaaaatcagccgggcgtggtggcgggtgcctgtaatcccagctacttgggaggatgacacaggagaatcgtttgaacccaggaggtgaaggttgcagtgagtcgagactgcaccattgcactccagcctgggcaagaagagcgaaactgcatctcaaaaacaaacaaacaaaaaacgggaaaggaaattacgatttcttgttggccaattacatgtcaagcacggtgctaaatgttgtcaagcactgtaaaccacctaattgtcctgaacatcatttcattagaggtgtctagtgagcaatggtaaattcacctgtgctgttatgaggttatacttgatttatctgagatacaaaaataaaatcacataaaagggggcagccaaagatttggttgaagccagcatgttggtccataggaaaaaagtgatagttgactgattcctatctgttaaatccggacattcatccacatgtgctctgggtgctgaactattctgtgcaaacaccacttcccttctccaaagacccagtgttgctacaaggctgctgcccggaaatgagcacgccaccattctgatcaactttggctcctttttattcaggaagcatacactaattctttttatacattttttttttttacattccagaaataagcgaaaatagcagttttaaatatgttacaaagttggcttttcaggcttaataagctttttgagagagggaccagccaactgaccttttcatcaaagcaccaatgtatcttcagtcttttaccaagctctaccacagctgtggttgccttggatgtgctgcacatccaaaccgtgtgaaagctataatggagagttgctgtgagtctctctgcaaggcaccaagaacaaacagttcaagcttcctttcttcagattgaaccaaagtttttgaaactttcaactgctctctcaagtagtgctctctcagcgtgaagactagaatttgttaaaacccatatatcacaagatacagtaaatcacttccaatagtctggaaatcacatggtagaagttataaataaatgaacactaaaattactttaagaaagttttacatcatttagttggtaaggacatttacgtgtacagcacaatttattgtcaaacattctataactggcttcacacaaagatgaaaatagattaatacaaaatgatctgacattttcagtaaatctggaattaagactggatttttattgtagtcaatatcaactttacatattgttgcagattgctgtgctatgccctttaaaatgataatttctcagggtaaaattccatttggatatgtgttcttgcttgtcaaactactaaaatctgagggacacagcaatatcaaagacacaaacagtaactgcacaatatcatctgctggattaagctaatacaagtggacagaattctttaggttccaatatctaataaaccactatgtgaaatgaacaaggtgagacatcttatgaatatactctgcaaccggaacatgtagcatttctttaattcaaaaatctgcctcattaggcatttacaaaataaattagtaagatctcaatttgcttgaggcataacaagctcgtaatggcccacttggccttcctgtttgagctgatctagtaggtcttccttccgtctttttctacctaccactaggtacctatcatggcccaccccatgagacttactcttaagaccatacttctgggcaatctgatgtatttgcttccgttcatcattagtcagctctctagagaaagtcaaatctgtgtggctctcggagcgggcgtagtttctgatgatctgttcaatatctctcttggcaattttattcaccctctctacatccagaccaagcccttcccgcttatgctgctctttcactgagataggctcccgtatgccctcaccagatttacctaaaccaccaccagtccaacccatctttctcagcagctgatttccaatattatcttctttgatttgctgtttgtaagcctcctctgctgagcggccctgaatttcatttcttgaaatcacatcttcaacagctcctttcttcaagttgttaatgacagttggctgggtctttttgagggttttcacagcttccccagcagcttcatatttgacagttttcttcaccccaactgcttctgcaattacttcactctctagaatcactttgcatttccagcggaggcctgtcatcctttcatagacatactcaactgtcattcggttaaactgagctgtgtcgttcagcgtgcacacgggatttgaagaattctcataaactacaagatcctttatatctttcttctttccagatcctctgggtgaagagcctgtatggcattgtgaacttttgacagatggataagtgggctgtgttttttgaagaattttcaaagcctcgtcggcagctgcatgtttacttgttttcttggttccataaccttcagctaagcagtgatcttgtaaaaacactcgacaacgccatgtgcgatttggcatcatctcatatttgtattcaattgacatcttgttgaatgaggcagaattgttaaggataccaattgcatcatttgcattttctgtaatgacaaaattggtccagtgtttggcagaagcattaaaaattggctgcccggaagcatctttacccagcaccaccaggtcttctggtggcttcagagctggaggaaattcataggaggacatgccaatctgacacaccacgaggtcctctccaaatgtatgcttgaatttccgccggacaactctaacttcaatacgtttctgcaagagttttacagctagctctgtagctcgatccctggacccattcttgctgccagcataacctgtagttaagtagatattttggcatctaacttcacaagcatagccatcagttagaagttttttatttttggggatgtcggcaggaggaatttcctttaaaggagcatatatatactcaggatttgtcttacacgcctgaatacaacgagttaacatatatgtataattaattttatcagatccagaagtcatttctggattagaaaggttcttccagattgtcgccgttaatttttcaataaaatactgcttctcggctaccacagactcgggaaatgtctgtgatggtgaaggctcaggagttgactgagagtttgcctgctgtgatgtggtgcttggggcagggttcccactgtcaaaatacatgttggctgttacaggctggtcttttgtgagaatgaatcctgatgaatcacaatactgagaattcccatcttgtatactgaaagagtcttgagtataatcttggtagatgtctcttggcatgctggcaaaatgtgtttgttcatttacctcttttgtttgagggccataaggatcttcctgtctttcatcttttgaactactagctacaaaatgtacaggctcaaaacgaggtctcgcatggaatttggaaccggcttgctttttaggaggattttgacctatagaatgagtgaaatttacaattcattaaaatgggaatatttcaaaagaaccaagcaggaaaatagtaccaaccatattatttgcaagctgcattgttggtacgagatacttccatcacaaaaacttcacgccatttgggtgaagagactcaattatcaatgtaagattccagcataaggagggatgctccctgtctttccacatgtaagggaagacccttgatagaaaatataccattaagtcaagtatacaggtcaccaccacacatgactggtagctgcttttgcatcaaatgagctaaagcacaggtgaagtatactcttcacttgtgctggaaggtgaagtggactggaagattgttccagtacaatctcataccacccatgctgaaaagctcacttaaggattgaaaatggaacagatggctctaatgcaagacagataatgagcagaggcagttacaaagcctttctcttttgtatcagaggtgagtgactctgtgatggtgctttacatagttgtgactaaaaatcaaagaaaaagaattatcaaaagattcagaaagttttcaacttcaaaacctcagctctgacccattcatcacaaaagggtgtttgctctattttctttctagaacaaacaacagctggaaactaatgatttatgtgagatgccaaatttaaagctatggaagaactctgatgaagctatactagacactagagcttcctccctgtaacactgctcagtagaaagctcgtccatcctggacccatccaagaggatttagtgacttagatgctcaagtgatcacagtataagattttatttagagggcggttccatgacataaatttcaaggactgcataataacatgatttcaatattcttagttttcaattctatttagcatcctcaaaaaattgtatataattaaaagctaaaactcttttacccgtaagaactaatgttaccaatgttatttgaaatcttataccacactcatatcatttttttaaagccatgttgtttcttcaaatcccacctttcagaaacaagtatactcaccatcacatgttgagaggtggcgtttttgacctttggaaggtttggacagcaccagatcatatgaaggcatctccccaatatcaataccttcagccatttggagaattttttccatcaagcgtgggctgtacctatttaagttaatataatctacagttaaaacaggtaaggatgtcttttttaaaaagcttcaaaataagccagtcttataattgctcccacaagactttatcaacagggtatcttggctataaaaccaaagaatcggccctaaaatatttacccatcaaatgaataattatgttactaattaggaaacaagatttttcagcataagacatacaaatataaactcaaaaaaatttagcaaaaacctcatctttaatttgaattgaaaatatcagtataaattcatgacttgttttgattgtggtctctatcatttctcatgaaatggaatcagggtccttagagaaatggctgattctaagtctgtggcaggaaatgtctaaggtgagcctgagaaatcatctagcacctaaaaccaaggaaactgtcaaagatcaaaggtgttgtgtcaaatggactcagaagccaatttgaatagactcttactggcaaagtgagccaactcaaatatcgataagaacaatgatggcaatggattgaaatatatcaaatatgttgaaaattcattagttcataatgatacttacaaactattattggtcacctttggaggatggaaggaaccatgtcattattctgcaaacaggtaaatatgaaaggaagaaagcaaacatttatcctgtattctcctgtataaattgtacttagagcaaccaaagagatgatgaggaaaatgtcttttagagaagcattccagctaataaatgaaggaatggactactaccattttgtaacctataataaaaaatgatcatcaggcgggcatggtggctcacacctgtaatctcagcactttggaaggcctaagcgggtggatcacttgaggtcaggagttcgagaacagcctggccaacatggtgaaactccatctctactaaaaatacaaaaattacccgggcatggtggtggacacctgtaataccagctactcaggaggcggaggc[131 bp omitted]aatggctgctaaacctattaggtgaaaagctaatgggggaagaactcacagtcagacccaagcaaatattctcaactgattattgacaaaggtgccaaggcaattcaatggaggaaggatagccttctcaacaaatggcgccggaactagtaggcatccataggcaaaaacaaaaacaaaaacaaaaaaaaaacaactctacacctaaacttcacaccttatacaaaactaactcaaaatacatcataaacctaaatgtaaaattatgaaacttttactgaaaaaaaaaacacaggagaaaatctgtgggatctagggttaggcaaacagttcttaggcttgataccaagcatgatccataaagaaactggtgataaaatggacgtcattgaaattaaaaagttttggctgggtgtggtggctcactcctgtaatcccagcactttgggaagccgaggtgggcggatcacttgaggtcaggaattcaagaccagtctggccaacatggcaaacccccatctctacaaaaatagaaaaaaaaaaattgctggacatggtggtacacacctgtagtccaagctacttgtaagactgaggcaggagaatcactcaaacccgggaggtggaggttgcagtgagccgagattgtgccactacactccagtctaggtctgggtgacagagcgagactccgtctcaaaaaaaaaaaaagagtaaaaagttttgctcttgaaagactgtgaagaggatgaaaggtcaagctgcagactgggagaaaatatctgtaaaccacacgcttgacagaagactagtagtacctaaaactcaatagaaaaaaaaatcaaattaaaaaatgaacaaaagacataaacgaaatacttcaccaaagaggatagacagattgcaaataagcacatgaaaagatgttcatcactagccaccagggaaatgcaatttaaaatcacaatgaggtatcactatacacttattagaatggccaaaataagtgacaatggctgggcacagtagctcacgcctgtaatccccgcactttgggaggccgaggggggtagatcacgaggtcaggagttcgagatcagcctgaccaacatggtgaaaccctgtctctactaaaaatacaaagattagcctggcatggtggcatgcgcctgtaatcccagcttctcaggaggctgaggcaggagaatcgcttgaacctgggaggcagaggttgcagtgagccgagattgtgccactgcacttcagcctgagtgacagagcaagactccatctcaaaaaaaaaaaaaaaaaaaaaaaaaaaaaagtgacaataccaaatgctggcaaaaatgaggagaaactggatcactcagacattgctgctgggaatgtaaaatgatacagtcactctggaaaacagtttggtagtttcttataaaaccaaacatcaggccgggtgcggtggctcacgcttgtaataccagcactttgggaggccaaggtgggcggatcacctgaggtcgggagttcgagaccagcctgaccaacatggagaaacctcgtctctactaaaaagacaaaattagccgggcgtggtggtgcatgcctgtaatcccagctactctggaggctgaggcaggagaatcgcttgaacccaggaggtggacgttgcagtgagccaagatcgcacgattgcactccagcctgggcaacaagaatgaaacactgcctccaaaaaaaaaaaaaaaaaatcagttaccacttgatccagcgattgcaattatactcttggacatttattccagagaaatgagaacttatgttcacacaaaaacctgtacacgaatgttcatagcagctttatttgtaacagcccaaaactacaatcagcccagatgtccttcaacaggtgaatagttagattctggtacacacacactatggaacactacttgggacaaaaaggaactttttttttttttttaaacagtctcactctgtcacccatgctggaatgcaatggcgcgatctcggctcaccgcaacctccgcctcctggattcaagtgattctcctgcctcagtctcccaagtagctgggactataagcatgcaccaccatgcggggctaatttttgtatttttagtaagacaaggtcatcatgttgaccaggctggtgtcaaattcctgacctctccgcaggcctcagccttccaaagtgctgggattacaggcatgagccaccgcacccggccatctctttgtattatttcttacagttgcatgtcaatctataattatctcaagaaaaatttcagtttaaaaagctgatcggggactttatcatcttaatatcactaaaagtgggacaaccgaacatgtaccccacgatgtgatacaataggatatcacggcactatctagaaagcgttatggctctccagagaattgaacctgaaactaatcaagttcctgactcccagaaacatgtgaaacaccacaagaatggaactatccaactccagaatgagggaacagtatgtgacagcccagtttcctcatcaaataaatactgtagaatgaaaataaaaggaagagggagtggttataggttaaaggagatggatcaatcaaatacattgtatagactttgtatcatgaatgaatcaaacgagctgtaaaaagacatttgagacaaatgaagaaaactgaacatgcaataggcattgggtgatttttaagaaatcactgtaaattttgttgaatatgaataatggtatggtgactatttttaaaaattcttatctgatacagatgtgtactgaagaatgtacaggtgaaatgatgtcaggattttataaaatatactccagactattgcccacaaaaacctagggcagaatagatgaagaagggtagcatggcagactgctgatgattgctgagtgatgggtacatgggattcattaaactcttttctacttttgtgtgcttgaaattttaaggcaaagctttaaaatatacaatttaaaaaatggctcctggctgagcacagtggttcatgcctgtaatcccagcacattgagaggtggaggtgggcagatcacttgaagccaggaattcaagaccagcctgggcaacatggcgaaacaccatcattacaaaaaataaaaataacaaacaaacagaaaacgtagccaggcatggtgacccatgcctgtagtcccagctacttgggaggctgaggtgggaggatcacttgagctgggaaggtcaaggctgcagtgagctgtgatcacaccactgcactccagcctgggtgacagagtgagaccctgtctcttttttttttttttttttttttttgagagggagtcttgctctgtctcccaggctggagtgcagtggcacaatatcagctcactgcaacctccacctcccgggttcaagcacttctcctgcctcagcctcccaagtagctgggattacaggcatgcgccaccacgcctggctaatttttgtattttttagtagagacagggttttgccatgttggccaggctgaccttgaactcctgacctcaggtaatccacctgcctcagcctcccaaagtgctaggattacaggtgtgagcaactgcacccggctgagacggtctcttaaaaaaaaaaaaaaaaaaggctccttatgaagattggctgcttgatagaataacattttactacagagaaacagaaacaggagctcaagtgaagtgttggttatgacggttacctgctctcccttcctaccttcagagccttccccagcctaggaccaaaaaagagattcctggtagcatttgggaagaagttctgaaaatgagtaactatcatacctttacatgaatcagttctgaaccagaaggagggtaacattttccattttcagtagaacaggttgcacacccatcacgtatcattccacgcaaagcagaagtcaaggcacggtggcctccccgacagactgctggaagctagctctgttgtaacctgtacttcccactgacaactgttgctgctaaagctagcacgagtatttaaataccaagagtaattttattttcattgactcttatctgaacatcagaaagcacagtctaaaacacaatatggctgggcggggtggctcacacctgtaatcccaacattttgggaggctgaggtgggcagatcacctgaggtcaggagttcaagaccagcttacccaacatggtaaaaccccgtctctactaaaaatacaaaaattagctgggtgtggtagcaggcgcctgtaatcccagctactcaggaggctgaggcaggagaattgcttgaacccgggaggcggaggttgcagtgagctgagattgcaccactgcactccagcctggacgacaagagcgagactctgtctcaaaaataataataaaataaaataaaataaacacaatacattctacatatcacttccattcaaatttgggagtacatatttccaaagtatgagataaaaacaaaagccgggcgcgtgtggctcacgcctgtaatcccaacactttgggaggccaaggcaggcagatcacctgaggtcgggaattcgagaccagcctgaccaacatagagaaacctgtctctactaaaaatacaaaaattagccgggtgtgatggcgcatgcctgtaatcccagctacttgggaggctgagacaggagaatcgcttgaacctgggaggcagaggttttagtgagccgagatcgcaccattgccttccagcctgggcaacaagagtgaaactccatctcaaaaaaaaaaaaaaaaaaaaaaaaagtctatgaaaatgagatgagtctataaatcttaaactactaatcccacgcctgttaccaaaagtggccctacaaccaggcaacttaccttgaattccagtcaatattctccagaccttcagttagagcccgattccaagtacagtatacaactgcaaatggcatatatgtcttacggtgtgatgcacttagggctcactcattcatgctcacttttctcaggtttcttccagcattagtaattattctacctacttactataccctattcattacatctgccacaaaattcaacttcacccataggccataaaaataagtctttacataggttgctgatacagttctctgtcctttgctatgaagtcataatactgaagaagcccagccagtatgaacaataatgaaaaagaccgtatagtacctaacaaacacttcactattcaaagaacaatgtaaatacgaatctagagtgtttagtaagaccacgaggcttctacaatccagagtagctttccaaagataaagaagtggtgccacatatttaaagtaagccaaggcagtaaagcttttattattcactttctccagagtctattttttaatagtgtgttttaaagtaacacctttaacaccaggcattttagaaaatccaccaagaaaagcacctacattcccaaccactggccgggagcagtggctcacacctgtaatcctaacactctgggagaccaaggcaagaggatcacttaagcccaggaattcaagatcagcctgggcaacatggcaagaccctgtctctacaaagaaaaaaaaaaaaaaaaagctgggcatggtggcatacacctgtaatcccagctactcaaatcacttgagcctaggaagttgaggctacagtgagctgtgatcacaccactgcactccagcctgggtgacagaggaacctgtctcaaaaatagttataataaccccaaccactgataacttcatcaacatgttgggttttaattaatttttttttttgagactgagtctcactctattgcccaggctggagtgcaatggcatgatctcggctcactgcagcctctgcctcctcagttcaagtgattctcctgtctcagcctcccaagtagctgggattacaggagtgcaccatcatgtccggctaatttttgtatttttagtagagacagggtttcaccatgttggccatgttggtcttgaactcctgacctcgtgatctgcctgcctcagccccccaaagtgctggaattacaggcgtgagccaccgtgtctggccatgtaggggtttattttttaatgctttttctgtgttttccataactccccatcactatcaagtcatctatgttgatttcaaatctggtggggttttttgtttttaatttactgtatcataagccttttctccacatcattaccacatgagttttaatggctatacagtatttatattattgaataaaatgtaagatatcattaaggcaagtctaatatagtaattttttaagatgcacgcatactatatttttaagtctgctaagttaccctttagattataaatgcttaaaaaagaaaaccaggccaggcgtggtggctcatgcctgtaatcccagcaattgggaggccgaggcaggcggatcacttgaggctaggagttcaagaccagcctggacaacatggtgaaaccctgtctctattaaaaatacaaaaattagccagtcatggtggcatgcacctgtagacccagctactcgggagactgaggcaggagaatcgcttgaacccgggaggcagaggttgcagtgagcggagatcacaggctgcactccagccttggcgacagagcaagactgtctcaaaagagaaagaaaaaaaaagaaccccaaaattctgaggtcttatggttctcaaaagtagctgatattataccaagcttttggaaaccaggatgtgactcaactatcccaccatatctagcacataaaaagatgatttctaatgaacaaaaacatctgtcttcataagttttacatctctggacacaagacaggtgcatatatatgcatacttatgaataacgtaaaccactataacatacaatggcagctgaaatttaataaatattcagtaatagatgcttacaaaactttttttttttttgagatggactctcactctggcacccaagctgaagcgcaatgacgcgatctcggctcaccgcaacccctgcttcccaggttcaagcaattctcccgcctcagcctcccgagtagctgggactacaagcacccatcaccacgcctgagttttaccacgttggccaggctggtctcaaactcctgacctcacgtgatctgcccgcctcgggctcccaaagtgctgggattacaggcatgggccaccggccacggccgttttacaaaactttaaaaaagtatattaaactgttctactaagttcaaataaaaaagctgagatttgaaaattaagcaaagattaaggtttccaagtgtaaaattgtttattcaaaactattcataaggaaaactaattaaaaaaaaaaaaaacttttcataagacgggccggagcctggcaaaatggctgatgcctgtaatcccagcacttcgggaggcccaggtggacggctcacctgaggtcaggaccagcatggccaacgtggtgaaaccccgtctctactgaaaatacaaacaaaattagctgggcgtggtggtgcacgcctgtaatcccagctactcggaaggtggaggcaggagaatcacttgcactcaggaggtggaggctgcactgagctgagatcgcaccattgcacttcagcctgggtgacagagcaaggttctctcaaaaaaaaaaaaaagaagaagaagaagaagaagaaaaagctgggagcagtggctcatgcctgtaatctcagcactttgggaggccgaggcgggcggatcatctgaggtcaggagttcgagaccagcctgaccaacatggagaaaccctgcctccactaaaaatacaaaattagtcgggcatggtggttgcacacctgtaatcccagctactagggaggttgaggcaggagaatcgcttgaacccgggaggcggaggttgcggtgagccaagatcgcgccattgcactccagcctgggaaacaagagcgaaacattgtcacacaaaaaaaaaaaaagaaaaaagaaaaagaaaaaaggactcgggccaggcgcggtggctcacccttgtaatcccagcactttgggaggccaaggcgagtggatcacttgagctcaggagttcaagatcagcctgagccacagagggaaaccccatctctattaaaacaacaacaacaacaattgataagactcctgatataagttaataacatacacccagattattgataatctttcaaaagctctcacacccatttcattagctagtgatttatgcactctccctactatgtgcacagttttgcaacatgagcccagccaacatctatctaccttccaaacaccagtcttgtatcaaccaggaaaagacaaataagggagcaaagctggtttcattttaaggtatattttatctattaattaatgtctcatcaaaggtaaatagtaggccagaattctccttctaatcttattgatcaacaatgactggaaaactaaatgccccagttaatcaaactgctttattaaatataaagacactatctacaattttaagtaaaaatcacacagttctctaggcattcatatgtacaattatttaagtgctgtagatgtagttggtcagaaaactgaactaatttttcactagccacaagacatatctcagaaattgcctgcagaaaaaaattcttggttaagttgtttacttggacgaaacagacaaatgaaaaaatgaagtgaaacaattttagccatttgagctttctggttgcctggacaattagggagaaaatgattaaaaaacagaatagaaacatttttattttatcctacaaagcagtggttctgagagtgctgatctctggatcagcaacatcagcatcacctgggaacttatcaaaaatacaaaatctgaggccccacctcagacctaccgagtcagacaccctggggctgggacccagcaatctgttttaacaagcctaacaggtgattttgacgtgtacttaagtttgaactccccagttacagagtcaagaagatattcaaatttgttctgtggaaattgccaccatcaccaaaaggaatgaaataaggtctgtttccctgcacatttgagttcctcctggcttggtcttatgatgaaggaattttcaaagatttctttgacctagaagtttatttcagctccaagtaaaatggaatacaaaacattttgccagagggaaaaaagagcaaggaaattcctttgtgctattcttcacagcctgttccaaaagtcaagtgataaacctcgagcaacaaatcaacaatttaaggccaggtgcagtgactcactcctgtaatcctagcactttgggaagctgaggctggcggatcacttgagccccggggtacgagaccagcctggccaaaatggcgaaaccccgtctctaccaaaaatacaaaaatgagccgggtgtggtggtgcatgcctgcaatcccagctactcgggaggctgagacatgagaattgcttgaacccaggaggtggagg[131 bp omitted]acttgagagaagagtattctgccacagaaaacaagaactctgccaaaatctacattaacatcaacaagtattggaacacaagttttacccacctgaagatgagaggtaacataaagcccatctaaagactgcacttggtccctagcttccaagagtcttcattggcccttccctttcttctatatggaagctatcagatataatgcaaacattacttttcagttaagctatttgataatgtaatggcaattcttgtattaactaaactgacttagctacaatgtaacatggtgtacatacatagtatgtacaatgtagcatacatagtatccacagatgcacctgtgtgcacacacaacagcctgcaattcttgagcctttaacaccaactaccattggcctactttgtgtttttaatgccctggttatgtacaagggtgttgttcttggaattaaatcctgagatataatgatgtggcttatgttcagttacttgctttcactcatgatccatccttcccaaatatggcagctgtggctcagtggaaagagcatcagtctgggtatcagaagacctaggtcctagccccagctgtaagaccttggaaacgtcacttaacttcttggcctccactgatttagcagtaaaaatgagatgccacctaatccccaaagttgttgtaggaaatgaaataataaatatttaaaatgtgttgtacatcataaagctgtatacatccactcactccacacacatttattgagcagctattatttagcaggcaatcttctaggcactgaggataaaggtgtaaacaagaaagcaaaatccctatccttaagggagcttccattctagtgggaaggtaagatttattattaacacaaaggatagttatcctcatttaagtttttgtttttattttaaggattcagatttccgacagccttctgtgatattatggagacttacgattataggataaaggtaacttttgaactcaagaacaacactgttaggcaaaggtcaagtagatttatctgacttgttcaataactaaggcttcttcagttgtaaccagttcctcctaatcattatctctggaggtagaaattatgctaaccttgagaagacagaaaagtaatgtctgtgatgagagcaaagtatatcacactgaatgccatgttcaataattaagggcaggaggagacaatcctatttttctgcatctgttacagtcactcctggaactgaactggccaaaattgacatgatcatattccagaatctctcacccttcctgatttaaaaaaaaacaaaaacaaaaacaaaaacaaaaaactatgattgcaggaatgtcaaaagaagtcgtctcccaatctatcaaagaatgaatagtctagtatagggccgatttaggggttctgaaggacagaggtccaagtagcctcttcaaaaaaaaaaaacaaacaaaacacgctgcgttggaaccatactgcagtctccattgaatgcaaagagctttcaaagaggcctgttcaaaacgtcaccaggttctaggaaaggggggaaaaacaaacacacacacacccccacccccaccacagacacacacacctaaaacctcactcagagccaaatgttaatccttctgatcccatttagggtaaaaagagggcaatccatttttacagtagatatatccatttctttgtttgagtccagacacattatgcgcaaatctacaagcaaggctgacgctgctgcggctcagagagctgatacgtaccgcctccccaggagaagacagtaagaccctgctagggggctgcaagtagaggggggtatttaagaggaatggaaaaagagagtggtcaggaggagactagaacagtggggtcccctcgcccttcccccacaactccaactgtcgaatatattctctgcggatactgcatccttggaaggccctacgcaggtccgagatgctgctattcatcattccccacgtcctctaataccgccaccaactacaatgaccacctctcaataatcctcttctaggcgctgcttcatctccatccctggtcctggagaggccgcttccgcgatctctgcaccctcctagctgttatgtcatgcccagccaccacagtcggccaccccacccccaggccaatagtgatccctctagtgccctccagcacctccaaatctccagcctccaacctatcctccgcatcccgcccccgtccctatcccaaccaccatcatcgatccctccagcgccgtccctaacccgatcccccatcaccgatctctcacccccgtccctaacccgacacccacaccttcctcacctgcagcccaggaagacgtggttggtccaggcggcggagagcgcgaggagctggtcgagggcagccccgggatagctgtgcaggtgccgacagatgaagctgcgccgcagagcccactgccagtcactttcgtggctatagcgccactgctccagcactggctcgggcgggggcggcgggaggggcggcagcggcggcggcgggagggggggcagcggcggcgcgacaggaagtcgccccccaacagcagacgtcctccagccatcttctccgcccccaagcagggaccccagggacgaagccgactacggaccgcgagctaggcagctagcaagcgggcggaaacggggggccggtgggaggggccgggtaaggaggggcgcgctgaggggagaagatcaactctcggggggactggagtgtgtgcgtgggggccaccgttaggaggaaaagaggagcacgagctcgcgtcccgacactgggatgcacgtcccctacactcctctaactcgtggaggagcagaagggcttccgccgcactcacgcgcgagccggggaggccgagtcaggctccgcacctccacggatccgcagacccacgcactgcgcggagagcgataaaagaccccagcacgctctgctcccctcctctaggttctagcctacctacccgcgtgccgtccggggttgtgaggccagtgcgcttgcgccgcggctgttccctaacttccaaatcccgtcgcagaatctcgcgcgacgtacttttttccctccagtgacgactacgggcctttgacgcactacggtgacaagcggagggcggggactccagaaagggaatttaggaaggttctctgaggttcgagaatatggttagaaggtgccctcagatgaatgttggtagcccacggctcgtctgacgcttttccctggatttttaagcggcgcgacagtgagaccatgttccttgtaagggatttaggtctgcactggactttacattaaaacaaaacaaaacagtcagctccccgaggtgccttttcttcagagagtagcttgaaatgctctgtgcatcgtgcatcattagctttgtgtaatagcttactgcggaaacgtagtaaaaatgaaacacttgccaagaaaatcatccacagcgccgcttctcaagttagccagtttcaagtccatactgtatcccaattacgaacacagatactgtttacacagttctgatcacgattgcaagtctgtatttcacgtatcaacttaagtgcaaaagattacaagatacaaaaggggcccacagaagagggtactgcaaggtagagccgctcaatcactgtagccaaatgtatcactccacccggagtcagcttcactcaataacttcagtccctatctgccaacctgtgtcacgaaagcagttaatcaatgagtgtctgtcggcgggaatttacacagcacctactgtgtgctcaatacagcaagagtacaaaaaagaaggaaagaaagtgggttttctctgttgtcctggaattgactacaatcttggtggggagaaatagccctgcataaaactaaatgttccaccaggagccggaccattggatgaggtggctttaacacactaccatctttaactctttaatgacgtatttctaattatatgacactttatgttaggggtgtattagactgagaggagcagaagataacagcactttacacactttcataatttatttccacgtctgtctttctccgtggtgggcattcatgtttattggggtaacaatcgaaatgttt[148 bp omitted]gaaacccctgtctccactaaaaatacaaaaattagccgggcgtggtggcaggcgcctgtaatcccagctactccggaggctgaggcaggagaatcgcttgaacccgggaggcagaggttgcagtgagccaatatcgcgccactacactccagcctgggcaacagagtgagactctgtttcaaaaaaaaaagaaagaaagaaaacagagcagtgcaaaggcaaatgactgggggaacactagatgaggagtcaggtgacctaaattctcatctcatcattgccaacaactatctctacagccttcggcaagacacttcacctctgtggccttatttttctcactcgtacaatcattacttgaatttattatctctaaccttccttcgtagtactatattctttgatttgatggtttagagactaacattacctcaataaacatgaatgcccaccatagagaaagacagacatggaaatacagaattctgaaactgaaaagtgctgttatcttctgctcttctcagtccaatacacccctacgcataaggtgtcatatagttagaaatatgtcattagagagttaaagagggcactgagtcaaagccacctcatccagtggtcctactgctggtggcacatttagttttacatagggctatttctccctacccagcttgtaatcaatttcaggacaacagagaaaaaccactttctttcctttttgtattcttgctgtattccactggaatgtcagttacatgaaagcatggaactcatctgttttggtcttagcacctataccttgatcctgcaggcactccagagatatttgttgaattaaatgcataaatgaatgaagctcttccttttgtctcaacccagtgaaaatcatttccttggagcctacattttaagctgatttgttattttataattagattaatttcagcctgctattgtttgagtgtgtccccttcaaaatttaagtgttgaaacttaatggctgatgtgatggtattaaaaggtgggacctttaagaggtcattaagccatgagagctcctccctcaggaatgggattaaggacctaatgaaagaggctttaatcggtgtttggtcacttgccctttgccttctgccatgtgcggatataacactcctctccccttgttgctggaggatgcagcaacaaggcaccatcttggaagcagagagcagagagctgccccaaccagacaactgaaccttctggtgccttaatcttggatttcccaggctctggaactctgagaaataaatatatattctttataagtctcaggtctcagtatcttgttatagcagcataaatggactaagacatagcctaagttgccaactttcaccaaaatccgcattgtaataaatatacatctttcctagaaaacaatctgtgaaaagataaactacttcctctcagcctggattaaaacttttccgttgtatagaaacaaataattgtaatctgacttttgaaattggattacaaaataaaaggtgttggaactgatgtaagaggccatctgctctggaacaaccataacaggattccatttgtaaatcccactaaggaataagcagtttcatccatagaacacaaatttccaggattctccatgtccttctctccctggtatccttctgattacaaaaaaatccatcagccaatctattttagcccattcctttctcacagccacagagggtttctcagtgagcaggagttaaaacccctgagaagaaatacattagttgaagagaggtgtaggcatagataataaag[136 bp omitted]accccatctctactaaaaatacaaaaatcagccgtgcatggtggcatacgcctgtagtctcagctactcaggaggctgaggcaggagaattgcttgaacctgggaggtggaggttgcagtgagctgagatcacgccactgcactccagcctgggcaacagagcaagactccgtctcaaaaaagaaaaaaaaaacaaaaataaaaacaatccggacaccacctgtaatcatccatcctcctcctctctattgcaggggtctgtcactgtcttttttttttttttttgagacggagtctcgctctaatccactgttgcccaggctggagtgcagtggcacgatctcagctcactgcaacctccgcctccctggttcaaccaattctctgcctc[134 bp omitted]gcctcccaaagtactgggattacaggcgtgaaccaccgtgcccggccgtgtcactgtcttaagacacataaacccccgttttgactgctttgagcttcctttcctgcttttgcctatagggggagtcagtacgtaatgaaaagacagaaacttggaacctgtcttttaactatcccataaactatcccaaaaatcagatcactaaaagttcttgacccgaaaattctgcaccaccatgtgctcttgaggaatgtttagtaacggattgaaagcataactaggagttctcactggccaattctgagtaatgtgagcaccaatattattaaagacagtaatgaattataaaccactgaaaacttgggagccataagtccacagtgataccaaatagataaataaatgagagagaagggagggcctttgcagggaggggctttgctttcagtcgaataccatgtgctgactggtaaatatggagggagtgctggagttggaaaatcatcattttatatagatcggtccaggcaaacattatcaacagatgctcaatccaaggagaaatttttgatgagtaagatatttccaggaacttaacagtttctctccacagattgtttattagtagcaataaaaaaaaaacagtaattatatcctggagaaattgggcaacaccttgacccaaaatgagaacatcctatttttaaaataggacttcaaaaatatcaatgtcatgaaagacaaagaagggctattccaaacgaaaggagagtaaaaagacagggcacaatgcataaacgtagactagatcctgtactgcgagaaaaaaaatgctataaaggatattatttgatagattagtgttagaatgtgaaatttacccaagttgataactgtctgcagttatgtaagaaaatattatctgtatatatggggcacatacatatatatggggcacaaaaatgataaagcaatagggcaaaatgttatcaactggtgaatttgggtcaagagtatgtgagtatacgttgtactattctttttttttttttttttgagacggagtttcactcttggtgtccaggctagagtgcaatggcgtgatctcagctcactgcaacctctgcctcctgggttcaagcgattcttctgcctcagcctcctgagtagctgagattataggcatgtgcctggctaattttgtattttcagtagagacagggtttctccatgttggtcaggctgatctcgaactcctgacctcaggtgatctgcctgcctcagcctcccaaagtgctgggattacaggcatgagccaccgcgcccagccgcattatactattcttgtaacttaatttcaaaatgtagtttgaaaagtgcaatagtgggccaggcgcagtggttcacgcttgtaatcccagcattttgagaggccaaggtgggcagatcacgaggtcaagagaccaagaccatcctggccaacaaggtgaaacccgtctctactaaaaatacaaaaattagccgggcgtgttggcgcttgcctgtagtcccggctacttgggaggctgagacagaagaatcacttgaacctgagaggcggaggctgcagtgagagatcgtgccactgcactccatcctgggcgacacaccgtgactccatctcaaaaaaaaaaaaagtgcaatagctcctgacattggtgaagaatataaatctagtgcagtggcacaatctctactcacttgcagcctccgcctcccgggttcaagcaattctcctacctcagcctcccaagtagccaggactacaggcatatgccaccacacctggctgattttttgtgtttttagtagagacaggttttcaccgtgttggccaggctggtcttgaacttgtgacctcaagtgatccgcccgcctcagcctcccaaagtgctgggattacaggtgtgagccaccacgcccagcctctagctacctcttaatcacttatcttgaggttgcactttactgggacctctggagagcttataaatgatgcccctactcttatgaagcttaacatctcttgaggagggaagtcccccaaataagaagcagagaagattatataagttcaagtaggggccggactcagtggctcacacctataatctcagcactttgggaggccgaggtgggcggatctcttgagctcaggagttggagaccagcctggcaatatggtgaagtctcgtctctacaaaaaaatacaaaatgtagctgagtgtggtggtgcgtgcctgtagtctcagctactcgggaggctgaggtgggaggatcgcttgagcccaggaggtagcagttgcagtgagccgtgatcatgccactgcattccagcctgggcgatggagtcagacagtgttaaaaaaaaaaaaaagttcaactagggagtttgaaaatggagaagagatcaggaatcaggataggtggatgagatcaagaaagtctttaaagtaggacctgagccttgaaggtaggatttaaatcagtagatgatatttcagacagagtcaacgaacagtttgtgtaactcagggagaggtttgtgcagagacagaatagactggacagagaacaaatattgggaagtgttgaaaaacgtggttgagtagatacaaggggccagtctgcaagttccccaagggcagcatcta[135 bp omitted]atccgtctctactaataatacaaaaattagccaggcgtggtggcgggccagggactacaggcccacgacaccaggctagttttggttacgtttcttaatggctgggaaaaaattgctgggcacagtggctcacgactgtaatcccagcactttgggaggccaaggtgggtggatcgctcgagctcaaaagttcaagaccagcctgggcaacatgaggaaacctgtgtctacaaaagatacaagaattagcggggcgtcggggcgctctcctgtagtcccagctacttgggaggctgaggcaagagaattgcttgggcccaggagctcgaggctgcagtgagctatgactatgccactgcactccagcctggacgaagagtgagaccctgtctcaaaaaaaaaaaaaaaatcaaaagaataattcaggatatgtgaaattcaaatcatatgtccataagtgaagttttattgagcacagccatgctcaacctcttacatattatctacggctgcttttgtgctgtagtaacagttgaatagttgcagagatcacatggcctgcaaagcctaaaatatttatcagctggcgctttacagaaaaagtttgcagctgggtgcggtggctcacgcctataatcccagctctttgggaggccgaagtggaaggatcgcttgagcccaggagtttaagaccacactgagcaacagccagaccccagtctctaccctcctccaaaaaaaattaaaaacaatctgggcatggtggcacgagcctatagtcccagatactcaggaggctgaggtgggaggatcacctgagcccaggattttgaggctgcagtgagctgtgatcgcaccactgcactccagcctgagcaacacagtgagatccagtctcaagaaaaaaaaaaaaaagtttgctcactcctgacctaaagcaatggttgtccacatggggcgattgtgcacagggaacattttggcaatgcctggaaacatttctggtggtcacaactgtggagggtagggagggcatcctactgatatctagttagtagaggccagggatagtgctaaatattctttaacgcacatgacagccctccagatgtctggtcccaaatgtccatagtactgtggttgagaaactctggattataggactctaaggtgagtactttctttttttttctttctgagacagagttttgctctgtcgcccaggttggagtgcaatggcgcgatctcggctcaccgcaagctctgccttccaggttcaagcaattctcctgcctcagcttccccagtagctgggattacaggtacgtgccaccatgcctggctaatttttgtatttttagtagagacggggttccaccatgttggccaggctggtcttgaactcctggcctcaagtgatccatccacctcggccttccaaagtgctgggattacaggcgtgagccattgcacctggccaggtgagtactttctagtacagggaaaactcagtccttaacaagggagcccactgactgaacgcccaggtctttaacttttagctcaggtagccttcacaatgaccatggcaaggcaatcactgatgtcctccttttctggagacgttttattaaatttttattttacttatttatttttgagatggagtctcactctgtcgcccaggctggagtgcgatggcgcgatctcggctcatggcaacctccgcctcccaggttcaagcgattgtcctgcctcagcctcccaagtagctgagattacaagcgcgtgccaccacgcccggctaattttgtatttttagtggagacggggtttctccatgttggtcaggctggtctcaaactcccgaccccaggtgatctgcccaccttgcttacagctcacaagtctgtagggctccagggcttgtaattttccataacacctcagtgcctgcctctgctcggtgacgtcacaaacgtcacagacgtattgtctcactcggctgtctcctagtgtgtgagctgcgcagagccaggcctatatacatggatattttctgaagcctccaggcctctgtaaggaaaggatgcatgccctgatgtctgcaccctggcccttaggaaaacaaagttgaagaaaattcgttttcctaagggccaccagagttctttaaagtgatgactctctctcttgcctactttaatgcttaggaggatgggaggctccgctctctagtagacccaggacacaaaatactccttagtatctatagaatgctttttgagtcataaagaatagtcatatccatgaattttgggggatgctcacatcacaggattaaatgagagaagacacgtggcatagagttcttttcctgccagaattaaaactcacctgaatcttgttccgtaggctctggcgctccacattctccatctaatatactaaatgataatcagctcaacttagttgaatccatgctaataaagaaaaagtggaggacttcctgcccacctccaccccaggtgttgggaatttcaggcccagctggaataaagttggagggggcgggcacgggggatggcaacccatctaggaagatttcataggctggtggtgcctccctgagcccttcaaatcacccactcagaaggcagccacccactcctcaggcaaaccgtggtgggccgcatcacccagtgacttaagatcagatcacacagccatttagcatttctttgaattttattgaaaattgacatggacattagaaaggtatcaggctaaacagtgctggttctgggatgtttctcctggagaatgaaagccccagaggggcaatgactggtcacacctttgagcaaaaagaacaaaggagaagaaaggaaaaacacacacagattctggaaaacatgcaaagaggctctctcaagagacactgaacagcagaatggtggtgatggtggtaggggatatatgagaatgagcacactcacatggtattttgatgcaagttaaaccaatgaattcaaggcagatttaccaacatcaaagctctccctccagatcccaggttgagcagaaacctctctcaaaaccctaactggtctcggaaggtggaatggagtaattttgccctcactaagcttaaaccccctcccttctctacctaagtgttagatagtggatacattttccccctttgctggaatctatagaaggtctgcgaatgctgaagaagatacaaatgtcacttgactttctcttgcatattcagaaatgtttaacagtggctgtagacagtcaacccatcgaaccagagaaatgtttaaaagaaaaacataaaactcaaacaaaaccttgtgaacagaacagtactttcatacccacagctgaggtgtcctgccccagtcacttacacttgggtgagtggtcctgtagttgtttctctgaggttacatttcgtccattttccagctctgatggttcttttcctgccttgttagttaggacaagacacttccatttaaaataccatgtgagtcaggaagagagcttcttgcctggacacagggacacatgaacacttgttgagtggtgtggtgtatgtgtgtgtgcttgcagtttgaggggagaggaaattggttgatttctgatttgagacaatatggaaccctaactcttctataatggcagtcttctcctttagacttagtgcagctgctgaagacaagattaaaaaaagctggaaaggagagagaaagagaaagaaaacatgaaattagccaaagaaagaggacattcaaagtaagacagggggaggggaatgggcaatattgaggtagcacagattgtagtgtgagaagacaggttagaaatgggggtcattgctgggccatcaccacggggaaatctgctgagaaggttttaagaacaccacacaccagtttaaagcttcttgttttaattaaaaacaagcacatattaacagccacatgtgaatgccaaatgattaaaacaaaaaaacaaaaacaagagccatctacactgcagctagggaaagcaaacttcttggcttaagagaagtgagggatgtgtgtacgtgtgtgtgtgtgtgtgtgtgtgtgtgtgtgtgtgtgtgtgtgtgtgtgtttcagaaaagccactccagtctgggaaaataaaagcacagaccatttctaatgactggttttgtttcaccagaagtaaacagagtacttagggtattttttttttaaatagtaacagttgtactaatttaaaagccttttcattgaagaaggaaaaaatctgtctacagtgagaaaagctacccaatgaaatacacattttaataggttgatcaactttttaatttatgttcactcatgggttcgatttttgttcaccaaacttccctgattataagggtcacctagggcacctgttacacacagtctcctggaccccgttccagccttgcagcatcactgggtcattgggttaaggagctggcccggcatgccttcgttttgccagccctcacccaatccatcttcagatgtttttctgtggaaaaaaacctcgagggtcttctaatactaactagtcagttactctgaacatcaaaagacctcgtatccaggaatgtaacgtatataaacagattgaatccctttgtgaaactgattgggagtcaggaggcatgaaaattagtctggcttctgcctcgaaacagaagtgggacctcggtcaagtcccttcccttctctgggccttcatttccccttacggagtaagtaggttatatcgtcttactgactaaaatgtctcccttaatataaaactcctccttagtttctgaaggtctctccaaggctgtgtgggtctaatacttttgaattattcagagcttctcaagccttaactagttaatctgtacacaaatgcaaatgagggcgcctccggtttgtaatgcaaataattaccgggcggcggtgtggggaagtggtggttaccggttggttgtttaagcgtgaatttctgggaaagcagctctgaagctggacatagaatcatcaaagttgcaaatatgaagcctttcccaaggagacctgacaggcctaactcagcatctctctgagctactggctgagtatctgagcagatttttttttttttttttttggtcgttggtttgtttctacctccaagcatatggtcttcaaaaaaatactccactgtaacttgaattttcccaagaaactggcttgtgctttggcagcatcaccttcatacttgctctggtcactcaccaatcaatagagcaccaaacctacacagcaaacctatattcttgctttgtcaacaagaaaagtgcgtgcatatgtttgcttttcatttttttctttttgcttcctattatgatctataattgaagtgagaaatccccttccccttctcaatacttcaaaaaggcctggaaatttggcataaccttgtttgactgtgtgctttgaaagtaagtgatcaaaaaaagaaactctaaaaaaaaaatagaagtaggtggtcatggtcagtgccagtggggctgggaggcaggagcaagttgcggaactcaaaaagaagaagtgagcttgaagtacatggcaggataggggtggggggcctcgctgcctggcaccccaaaggaaagctgtcagttaaaataggaacctcggcttaaaaggctaaatggagtccagtccagctgtagcggggaatactattcagtacacagccatggattactgcaaaggaagggcagagagacggcatgttagccacagatcattgccaggtcaactccatctctcacactgtcactggccaaacaccaaaggccactgtgcctcataaccctgacaagggagggctctctacttcacagaggttcccaaagccactatcagatgggacccatgataaaaacttagggctggaatatttttaaactctcaactccttaaattggaaagaaagttaagggccttttcttctctccggccgagtctcatctcttcttattgggggatgcatgcaaaatgcatgttaaaaatcatcatgacattcaccaaatgaactagaagactcatcagagcaaacccccaaacacttgattcttttgacagctcagttttccagcctacaaagtgggatttattattcctgctactggcctcaccttattgggacagtatggagcccttccggaaattaccccccgagatgctgaaatacctcacaagaagaattcggtaaggctatcattcaagactctaggctggtaataatattcaggtttattctcccttttgcatctgtgggatacccagagttagagagaggggaaacgtctgctattttcttcagcagttgtgttttatgggaagggcttggtgtaaataaatgcgttgccgattttgagcacagcttgagtgcagttacttcgagtgaatgaaaactggaaagggctggactcaaaggttagaaggaaaaggcgccaaaggctgtccttttgaaaccctctaagaaatggctgtggctcctgaggatgagggtggggtggaccagggaggactagtgactgggatacaggagaccaaggggacagctgtgctgatcggtggttacccagccatggtggttgcaaatacctcagggaaactaacagcaaccagaactggaacaggggagctggtgggaaagagtagcagatgggccccctgaccatgtcacacctctggcaaagatgtgggggaagacaggggggatggctgggggtgctgggagggggactgggatgcaggatgcatctgcgagccacatgactgttggcttcttgaccagcggccagacatcaccctcagattctcaggtttctataaaccttggcaggaagagaggagagggcgcgggttggattgtatgccccccaggcatgttaagggggaaattagagaaagggaggcccagctctgttgcgcaggaaaagggtgtctacaggaagcccaaactgaaaatgaaaagagaagctgagttaatgaatggatagattaatgtaccaaaaaaaaaaaaaagtcagaagaaaattaagtaatgaggactaatggctaaattagaatatagctatgttagatggtcttaaggtcttattgcattggctccggggaacatgctttctctctcatacactccacacacactcccacatgatggcagcagtggcattagccagcaaaataatgatcaacaaccacaaaaatacattttatctttctttctttttttttttttttttgagacagagtcttgctctgtcacccaggctggagtgcagtggtgcgatctcggctcgctgcaagctctgcctcccgggttcacgccattctcctgcctc[222 bp omitted]tgcccaggctggagtgcagtggccgtgatcttggctcactgcaacctccatcttccaatttcaagcgattctcctgcctcagcctcctgagtatctgggattacaggcgcctgccaccacgctcggctaatttttgtatttttagtagcgacgggggtttcatcatgttggccaggctggtctcgaactcctgacctcaagtgatccacccgcctcagcctcccaaagtgctgggattactggcgtgaggcactgagcccggcctatctcttcttaatgactaggtcctgactagtgtcccccaccacccacccccagcaccaccacccacccccagcaccaccacccaataccttgtacaggaataccttccacaaatctctaagtggcctcaggccactggatagagccccaggctctagccactgcatttcctgtcccattgggaaagtagaggaggctgaggtttcaccccaggagatccttagagctgtcctagtcagctaactggtactctggggcaagacctgtttgcagagcatatggggatgattgcagaactctgttctagggtccagaccacagttacctgaaaatgtgaactatggaaacccatcattggtttgtgcttaaataatactttgacctctcttccatgtaaatttcattcctgtgacataaatacagcaagtagaactgatccccatttcatatgagtagaccaagaaacacagagaagtcaacagacttgcctgtggctgcaaagagtcacagctgggcccagagctggtgtgtgtgtgtgtgtgtgtgtgtgtgtgtgtgtgtgtgtgtgtgtgtatttttatttcttttgagatggagtcttgctctgtcacccaggctggagtgcaatggtgcgatcttggctcactgcaaccgccgcctctggggttcaagcaattctcctgcctcagcctcccaagtagctgggattataggcacccgccaccatgcccagctaatttttgtatttttagtagagacagggtttcaccatgttggccaggctggtattgaactcctgacctcgggtgatcctcctgcctcggccttccaaagtgctgggattacaggcgtgagccatcatgcccagccaactctcttaaaaaaaaaaaaaaaaaatagagagatagggtttcaccatgctgcccaggctggtctccaactcctgggctcaagtgatcctcccacctcagcctcccaaagtgctaggattacataagtgagccacctcgcccagcttccatttactcatcttgcaaactggggattattccttctctacctcacagacctgttgtaagtataaaatgagatactatacaaaagacaaaaacaaaaacaaaacaacaacaacaaaaaaaaacactttggaaagtaataaaagctatacaaatgctcatatcttatttttattctttgtctacttcctaggggaagagtaatctaaaaaacactgcaatggcctatgttctaggtttcatgggaaggctgacgtattttgatgtgtgtatactatccatatactgtgcactcctaaggaccaataatgattgaggtagagtatctgcaacgatgtagggggtcacaaaggaatcgcttttacaaatgcagagagctataagtagtgcctcaagcaatttcaaaatgtggaggcacagtaagcctcactctgcctgcattctaggtggccttcgtgatccaccccttgaatgagggctttgaggagggggcgggttgcctttgctgctttcagatcctggggagccaaagcctcccctgactcgttggtctgaaattgctttcgtggtctgccagggagaatcctgccaggaagagccaacctacttggggttggggttggctgttccagctgtttaccaattgcctctcacttgtaaagtgtagctttaattatagttttgccagaattcattttaggaatggccactaacaatgatttacttggggaaacctgtaagcaactgtgtcaagccacgtgcagtgaaacctgaattaactgaaatctcattaactagaatacatatttcctgctcacctcattaaaaatgggagaacaaagaacataacacatgaactgagttcctattacatgtcagacacttcactacgcactggaactacatacagtgcaaagaatggacaggcattctaggaactgactgtcttcctaaatggaaatctgctgtttaattccagtcaactagcaggggctccaagacttgctgttaagccagacagtaaatcaagtcactgttcttttaagattgtttcctttggcccggtttcatgggccttatgttgcagaaacctctatggacttcctcttcaggatttgcttccaagcaggatgttttgccagctgccccgagtccccagtgcaatagctgcggcaatcagtttggtgactaacagcaggctctccatttaaatcataaactacatgggtgagtggggaaaagtcttctctatattttatattccctgatccaaacaaaccaaatgtaaaagggcatttatgagacaaccgggatgtttcaaacactgactagacatttcatgttaatgaattattgttcattttgtaggtgtgataatggtggggttgtggttatgtttttttaaagaatcattatctcttggaaatatatactaaagtatttacagataaaatgatatagttttgctttataataattcagcaggtctgtagtaattgatgaaacaagattaggcatatgtttatggttgcctgggggctgaactgtattatcctcttattttgctcatgtttgaaagtttccacggtaaagtttaaaaaaaataataataacccttcatcgggcgcggtggctcacgcctgtaatctcagcactttgggaggccaaggtaggcagatcacctgaggtcaggagtttgagaccagcctgggccaacgtggtgaaacccggtctctgctaaaaatacaaaaattagccaggaatggtggcacatgcctataatcccagctacttgggaggctgaggcatgagaattgcttgaacccaggaggcggaggttgcagggagctgaggttgtgccactgcactccagcctcggtgacagagtgagactccgtctcaaaaaaagaaacaaacaaacaaaaaaaaccctaattatgttaaattaaaaatgtttgtatttcctttccatccactacctgagtctagtagaggagatagaaggtccttaatccctgctttcagtctccctataaactatgtgaaactttataaacttctattaacacaacatctagcactcaggaatccttacctgctgatctccttataagaggttttcatgaagccagtacttgtaggattaaatgtaaggaattctctataatttctaagatctcttcattttcctccgcttttattatgggttttttttttttgtttttttttttgtttgtttgtttgtttgtttttttgagacggagtttcgctcttattgcccaggctggagtgcaaaggtgcgatctcggctcactgcaacctccgcctcccaggttcaagcaattctcctgcctcagcctcccgagtagctgggattacaggcatgcaccaccacgcccggctaattttgtatttttagtagagacaggatttctccatgttggtcaggctggtctcgaactcccgacctcaggtgatccgcccgcctcggcctcccaaagtgctaagattacaggcgtgagccactgctctcagccttattatggttttgaggggtacagtcaaaggaaatttgaggacttgaacccctcagatatgaaactgccaccagcgggaaacagagaagtgagtttccattgactctggacattctcaaacctgatgcagggggatgggagagggttgatgctgactgtgacattgcaggacggagcttgtgaaacccagtttctctcatcaccacggtttcattaattttgaaaataatggttatagctccttttgtttttgagatggagtttcgctcttgttgcccaggctagagtacaatggtgcaatctcggctcactgcaacctccgcctcccaggttcaagcgattctcctgtgtcagcctccagagtagctgggattacaggcctgtgccaccatgtccggctaattttttgtatttttagtagagatggagcttcaccgtgttagccaggatggtctcaatcttctgacctcaggtgatctgccctcctcggcctaccaaagtgctgggattacaggtctgtgagccactgcgtccggcccgattatggctctttaagaaaaaaacttcccacactgaaacctcaaatactgatcacaggatccacctgtgttacccagctgttctagcagcaaaagtctgaaaacgacccctcactttaatcaggcaggcaggcaggcattccacatgtacacctgaaaccacaccagactatttctgcatattataagtcacgagagaaaaccagctagaccaatgaagcagcttcttctacgattagatgcttgtgttgggggtgcgggattgggggagatatgttctagaagccactgccagttctatttagagttaatcaagcttaccaggaccctgggtctcatgcagcatgcagcaaacagcagagttaactgtaaaacagtaagagctgatgaagatggagtgagcatgaggggaaatcaaatattatgacttgacacaaacaatgaagggttagaggtcaaaggtgattaggagtagcaggaaggggaagtgggaagggtggactggtaggaacccctgaaacactgatactcttttttttttttttttgagtcagggtctctctctgttgcccagactggagtgcagtggcgcaatcatggctcactgcagcctcaacctcccgggttcaagcagttctcccacctcagtctcctgagtagctgggattataggcaagtgccaccaggcccagctaatgtttatttatttattttttttgtagagacaaaggtctcactatgttgcccaggctgatctcaaactcctggactcaagcaatccttcgccttggcctcccaaagtattgggattacaagcatgagccaccacggctggccagtactttcttaatctctttaggggcagctaaaggaaattctgaatatgtgactcttagatccaaccaccatctctcaagaagaaatactactaccaccatttctgccctcaaaactcactaccgtgactatgggaggagggtagcacaggtctaacggtggctcttccagaagttaacaaattgctcatgaaattacataagaagccaagattcagggccacttctgcatctggaagtacagaagaagacaggtcattctgttaggcccttattgctaatataaggtgccacatgccagcagggttttcacccatttcagaattggaaaggggcactgtcaccaaccccaaatattcctgaagagtagagaggggtatctccctgttggggtctcctgcctggggtgggagaagtcagtcagtatgaggcaacaaggggaaagcttgatgtaagaagaacttttactgaacatctgaatagggaatatttatagtttcattgtagcctgaacaaaccaattcctaactcccacaagcaggctatgaaactgccccaggtactgagttaacaaataccacaggactatgaaggcagcaggttacagctggatgacaaatttagatttttctgatcttaaaaataggaattcattcctgctggtgcaactaatacaccatgacagataagttaatacagtacagggtgtgtccaaagagacttttttctggctagttgaactttatccatcaggtaataccaaaaaatttcattcatcagtgaatttgacatatagtattaagattcagtaagaaaaatttctggactaattggtgaagatgttctttttttttttttagacaaagtctcactctgtcacccaggctgaagtgcagtggcatgatcttggttctgcaacctccacctcccaggctcaagtgattctcctgccttagcctcctgagtagctgggactacaggtgtgggccaccatgcccagctaatttttgtatttttagtagagacggggtttcgccatgttg[135 bp omitted]tgcaaagctgaatgccttcaaatataacatattttactgttatgcaaaagttaccatgttattcctaagtgataagccagaggaaaggaaggtgtttcttccttctggcaaaaatatcccatagttaagtccaggaacaaatggctgaaaacagaaggcaatgaccatggacaccttttggatcctcagtacccttcagtaaagacacagctaaacagtccacctgggaactcctcaagccacactgcacaaacaactgcagggcacaagggcaccacaggagtttttctagatcccgttgaaatatttttctccagttctgggatgaggaatgggtaacttcagcaagcagagactggggttgggtgaggattattgacccacatggtatccaggagccactgttctaataccaggggagatcagaaggtcttacagtcattccacagattgaggatggggcacatgcagcatacactggcatctgagggctcccccataagttctcagcaccccaggctaggcagaactaagccagcagggagggatcacaaaggggtgggaaatcagggctgagctgcagccttcactggcagcagttaaattctgttggctgcagagagtaataactgaggcagggtgagggtgggactacggccatggagaggtgagcaacctcagatatagggcaagggtggggagagggtgcaccgag[138 bp omitted]cctctgcctcctcagttcaggcaattctcctgctcagcctcccaagtagctgggattacaggcgcacgccaccacgcctggctaattttttgtattgttagtggagacaaggtttcatcatgtaggccaggctggtctcgaactcctgaactcaagtgatccacccgccttggcctcccaaagtgctgggattacaccacgcccggcccgtagctgcagttctttttgttcctctctttcttttctatttttttttttttcagatggagtctcactccgttgcccaggctggagtgcagtggtgtgatctcagcttactgtaacctacacctcccgggttcaagtgattctcctgcctcagcctcctgagtagttgggactacaggcagctaatttctgtattttttttttttttttagatggagtctcgctctgtcgcccaagctggagggcagtggtgcgatctcaactcactgcaacctctgcctcctgggttcaagcaattctcctgcctcagcctcctgagtagctgggattataagcgcgcgccaccgcgcctggctaatttttgtatttttagtagagacagggtttcacca[137 bp omitted]tgcctcagcctcccgagtagctgggactacaggcacccaccaccacacccagctaatttttttgtatttttagtagagatggggtt[132 bp omitted]agacggggtttcgccatataggccaggctggtcttggactcctgacctcaagtgttcctcctgccttggcttcccaaagtgctgggattataggtgtgagccaccgtgcccggccttgttcctctcttatattgctgcacctctaatttttttcttcccttctgctctctcactctcctttgcttttcctcttttcccttcctttcctatggaccttgagtttgcagggctttcctgagcaagctggacagatgggctgggcctctgggaccacacccctctgctactctcaactccccaagctcagggaatccaaaggtgccacagggatgctgggaccagttataggtacctcaaccagtctgacagcccacagctcacctctggtcaccagtcctcagccccttcaggtgccacgtcctgccctgggaggatgagcaggaggaaagagaaggcaccaccccagagcagcctgctacttactttttcttctctttgtctctcttcagagtctgtgagcctccagcctgggagccctgggactggagcagctcagccgccgtctttctttgcttgaaagcattcacttcatcatccagggatttcttcttatcctccagtttcttcttctcgtcctggtgcagtttcttcagacggtcaaacttctcgtgcagctggcagggaagcacagggagattggagagaatcccctgtgagcagtccccagcctggccaagcccaggtgggtggggaccagtagggctgtgaccctgcaggaccctggaacctcagggggcatttctgtcagggattgctatgatggcaccaaaggcaccatgctctggatcgttctctcttcctgccattttatctccaagtctctgctcctgaatatggtaaaggaatactgcattgtgtttagtcagacattttgttaaaaagagtccccatagttaccacacatggtcaataataacatcaattataataatataacatttactgagtgctggccgggctcaggcctgtaatcctagcactctgggaggcca[134 bp omitted]gaggcagaagaatcacctgaacccaggaggcggaggttgcagtgagccaagattgtgccactggactccagcctgggcaacagaggaagactccgtctcaaaaaataaaaaaagaaattaccgagtaattacaggctaagcactgacttttataagtcctttatgtatattaatttatttaattgttaccacattcctatgaggtaggttccgttattatctccattttatgaggaaacagaaggtctgagaagtaaggaatttgactatggtcaacccagtatttagaacattatataatgggacctcttatgtgtaaggaacccctgtcttttcttaacccctgcaatcaggaaggatcaccatggatctcagagaaaacttcagtatgggaaagccagtcaaggaaatacttggctttggacatggaaggaaataaaaaggactttatgacatggaatgagtacagacacctcagccttaactaaagggaggcttaattagtcctgaatagaaccagaaacccaaagaagaacaagaagaatattctgggccaggcacagtggctcacgcctgtaataccagcactttgggagtgctgtaatcccagtagtcggctcaatcccagcactttgggaggccaaggtgggtggcataaggtcaggagttctagaccagcatggccaacatggtgaaacctcgtctctactaaaaatacaaaaatgagctgggcgtggtgacgcttgcctataatcccagctacttgggaggctgagacaggagaatcacttgaacccgggaggcggagctttcagtgagccgagatcgcaccactgcactccagcctgggcaagagtgagactctgtctcggaaaaaaaaaaaaagaatattctggcatgccattgtggtaagtggatcagagaacaagaggcacagacagtcacaaactagaatgcaataaactaccctgaatagtaagagcagagcaagccgaatttcactttctttcatggattcaggagagagtttaggattctgtagcacttgcagcatacgatgaagaaggttagttctccgggtcctgggggtatttggcactgtcacttaggtg[142 bp omitted]ggttcaagtgattctcctgcctc[133 bp omitted]tggcctcccaaagtgttgggattacaggcatgagccaccacgcctggcctaaagcagctcttactagtcactagggctgcctatcaattgccttaacctggtttttgtttgttgcacttttattcatttgtctttgagatcccctcacttctcctcctaaaagtgctgggtgacatttttgttttttttattgagacagagtctcactctgtcacgcaggctggaatgcagtggcctcgatctctcggctgaagcattcctcctacctcagcctcctgggtagctgggactacaggcacgtgcaaccatgcctggctaattttttgtatttgtaattattttttttttttgagatggagtctcgctctgttgcccaggctggagtccagtgggacaatctcggctcactgcaacctccgcctcctgggttcaagcaattcttctgcctcagtctcccaagtagctgggactacaggtgcgtaccaccacacctggctaatttttgtatttttagcagagacagggtttcaccatattagccaggctggcctcaaactcctgaactcgtgatccacccacctcgacctcccaaagtgctgggattacaggtgtgagcaactgcgcccagccaattttttctatttttaatagaaacagggtctcagtatgttgcccaggctggtcttaaactcctgggctcaagcaatcccctcgctttaagcctcccaaagtgctgg[131 bp omitted]cattctcctgcctc[225 bp omitted]caatacccttgtcatgggctttggtgagaacccttgagagtgtgacaggttaaatgtggaagagaatcgtgaagtaattaagtgtttcctttctttttttttgtttttgagatggagtcttgctctgtcaccaaggctggagtgcagtggcatgatctcagctcactgtaacctccacttcccagattcaagcgattctcctgcctcagcctcccaagtagctgggactataggcatgtgccaccacactccactaattgttgtatttttagtagagacagggtttcaccatgttggccaggctggtctcgaactcctgacttcaggtgatccaactacctcggcctcccaaagtgttgggattacaggcgtgagccacagtgtccggcccaatgtttggatttctgttcctgtgttagtttgctgaagataatggctcccagctccactcatgtccttctaaagaacatcctctgattcctttttatggctgcatagtattccatggtgtatatgtaccacattttctttatccaatctatcattgatgggcatttgagttgattctatgtctttcctattgtgaatagtgttgcagtgaacatatgtgtgtgtgtatctttataataaagtgatctataggattgctgggtcgaatggcatttctgattctaggtctttgaggaatcaccacactgtcttccacagtggttgaagtaatttacattcacaccaacagtgtaaaagcgttcctatttttccacagtctcaccagcagctgttgtttcttgacattttaataatcaccaggctcacatttacctctttctctgcctctttgagctccgcttctttctctttgactcgctggacgaacatctgtctcatctcctcttcttttttctggagttcccctaggaactcgttccttttggcctcatatgtctcctgtaaactgcgaacatggtcaggttaattcttcttcctttggaatgattcctatttgataaaactggccccaaagatcctcactgggttcctctgtcctcccttccccagttgtgagccaggtacaaaaatagaaccacaaagctgtgggcacctggcttggcccatgacagcatgcccacagggattctggagggggatggggcaaccctagtgaactggagagacttagaatatctggttctatactcttgttctacggatgagaaaactgaggcccagagaggtgaggtgtcttactcaaggccccacggctagttagagggagaactttgaccagaagctgagtctcctgtctcttcatctgggttttcccactgcacaatgctgccaggccctggctctgaaactgaccacattaatgaactatttcaacaaatgcttgaggagactccatatgtgctagactcagtactaattgacatgatgctagtcactcagcctctagagccaacagccatcatacctgccatcaaggaactcatggtctagtgggagatgcccctggcctaagcttatttttaaagaaataggagataggctgggtgcagtggctcacgcctgtaattccagcactctgggaggccaagacgggtggatcacctgaggtcaggagttcgagaccagcctggccaacatggtgaaaccccatctctactaaaaaatacaaaaaattagccaggcgtcgtagtgggcgccagtaatcccagctactcgggaggctgaggcaggagaatcacttgaacctgctaggcgaaggttgaagtgagccgagattgcgccactgcactccagcctgtgtgacagagtgagactccatctcaaaaaaaaaaaaaaaaaagcaatagcctggtgaagaagaggtggaactgtgatccaaagagggcagcatgtaagaaagcaggtgtgaagagagaatgacattcttggggagccaggtatggttcaacatggccagagagcaccatggcagtggtggagtagaggcagacaaagttcctgagcctggaggaagagaacaggctttgaatgccatatttaaaaattggatatgtacacactgcatggttttaaagcaggaagtagtactagatccaatttgaaaatgagaaggaccattccggctgtgctgtgggaaggatagactgtccatcaatccaagtaagaagtgacaggatcttggccaggtgtggtggctcatgcctgtaatctcagcactttgggaggccaaggtgggtagatcacttgaggtcaggagttcaagaccagcctggccaatatggtgaaaccccatctctaataaaaatacaaaaattagctgggtgaggtggtgggcgcctgtaatcccagctactggggaggctgaggcaggagaatcgcttgaacccgggaagccaagat[131 bp omitted]gggaatggagggagcagtaagggaagcagaactcccaggacttgggaggagccaaaggtaattctgattatccttgggcaaccaggtggatggtggtatcatgaatggcaacagggaatgttggagacacatgcttaagagggcagaagatgaatttgtacagagcttgattttcggggaggtcctctatgggatgtctgagtggacatccaggatgcagttggattaatgggtttagacctcagaagtaagactagcttgggaaccatctacttctaggtggtaattagggctgtgagagtagaaagaaccagctgcaaagagaacagaaagtgaaaggagcagaggctctaggaaagaatcccggggggtatatcaacatttaaaggagtaaggtgaagaaaacgagcctgcaaaggaggctgagaagaaatagtaggagagataggaatagaatcagccaggccagtgctagaaaagccaaaggcagagagcatttcaaggaggcagtggggaatggcataaagtgctgcgttgatatcaaataagatggaaaccaaaggccacattgaacttggccacaagtctgcgattcctggccttggagagaggcatttgagtggttatgctggggacagaagccagactgcagtggattgaggaatgaatgagagatggggaagaggaaccagtaaacatagaacaactctttctcctcatcctgtcaaggacttcttgacaggacagaggctggtaagaaagagcagggttaagggagagtttcttcagcacaagaatgcttacatgcagcatgggaaggagctggcagagaaggagtgaagaaggcgaagacacaggaaacagaggtattcaggatggagtgaaggaggagggaaggagacaaaatgaccaggtggaggcacacctactcctctacaaatgcagatgaaagctgcaggtggggaagacagccagggagctcccaccagaaaaagacaagcatggcttcccccagccccacctgtcagtatatagggcatgagcctgtccctcctgaagcaaatatccccaagggactggttaggctctgactccaggccagctttaggctgtgcacaggtagagtaagatctcagaggctctttgaaagcctttttaactggtagacatctccctcacttgcttattaatgcctgaccaccataaagggcaccacgtggtaatttcaactgtggggcttatttcacacatcacgcatatagatcagacacttctacttggcgcattactcctctctgcataataacctgctttcaaaaacattccccttctctaaaagcattctgatttaagaaatatggcagtgatgatcaacatcctgcggtcaaaacagaacttgcacttgaatgcagacactaaggacagcaattggagagcctgcagttcatcgatgcatggcaagggcatgctacctggtcctatctgggtttgagaatggggaaatgggtaaagaacagactagaaacctgtctgagcgccaggagcctgatgaagaaagaggggcagaggacagttaccaactgccacctcgtggaacagggccccagcttggggattccccccagcgcagctgcttggagctgtcatggatgcgtgcatgtgtgtgtggtgatcagccttgctggtcctctgggcatcctcccttcccttgcccttaaaagcaaggcggcggtacttcccaagcctgctccccacagctctcctggcaggtgtgcagaggcaaagggtgaacaggcaagcagaactggcaagtgagtcgcccctgctccttgaggtcttagcacccgtgtctcgcctcccctgtgaattctccaggggaaggcttccacaccacctgagtgggctgagctgagctgggctgggctgggctgggctggcaggagcggtacctgaagggtttgctgtcagggtcggtgtccttgaagcccatctcctccagcttacagcggcgatacagctcatagtgccgggtgtgggtctgctcccgcagatcctccatgttgacccgaatcagcatctcccgcagcttcacaaagtcgcagtgggcctcgttttcaactgcatagcaggatttggggtattgaaagtatgttgaaaggaaggccagcagaagcagaaatggatgaaacgagaggcaaaatgtctaacagtgacgttgccttgcaatctgtgtatttagatcctgcaaatttacctcctctcttttctactgaaaatgtaaatgaaaggttacaaaaatgccagtaatgaaaaactgtgatatcataaaaatacttattaagacagtcagtagcaccacaatctaaattcagcagtcagaaccctcaaaagaatgtttggtctgcaccacttgtaggacaacagcatatatgcatctgtccatccatccatccatccatccactcatccatccatccatctatccatccatccatccatccatccatccatccactcatccatccatccatccatccatctatccatccatccatccactcatccatccatctatctatccatccatccatccatccatccatccatccatccatccatccaatcaatatttgtggaatctctgttcccagtattgtgtgaggcactgggaattcagaaacgaagtgatggaatcttgctctcaggagcttatagtttagaggaagaatagatacaaatagacaaatacaattcagtgcacaactacaaaaatagagggatagccaagttgcaataaagctcagaagaggggaacctaagaactcctgggaaagtgaagacttcaccgaagagaaaatctctaagatgactctggaaggaagaatagcaatttatcagccagagaagggaatggtgtttgcaaagtgtcaatgaggctaggcaaggttatgtagctagtaagttgcagaattagggttcaaacccaggcaatgtaggggaggtgacaaagtctccaaagaataaggggaaagaactaggatattgatagatgacagtgacaaggaggggtgtggaccgcaggcatggcccacctggatggtagaagcttccaaggaggtggtttctttagaaggtagataatggcctgacagtagcagtggtgactaggagcaaggggaccccactttctggcctgtgtgaacaagtcccctcctcaaaagagtgcaagcaaaggtctgcaatttggggcagtggtcaagaatgacagatgtggaccaagtcatagcaaaatcgatttctggctggaccaggtcacgaggagcactttgtcaaggtggctacaggtatggcttcactgtgtcggatggtggtatttgccctgaacaagtaggaaaaatggtgtctgaagtgaacaggcaatcaccccagattctgtcttgcagggtctggaagagggtagtgagggcagagaagggtctgggataagtgggtcagccatagttgaagcagactaccttgtggtcattaatctttccaaagcccgaatcagctcacataatccctctgcttaagacccactgaattaggaataaagccccctgctgtcatagaacacaggctaatattaaagatgacatcagtaagacaacttctcaggactatgctatatgccatctcctcctccatctctggacagtgatctctaatggtgagtcagaaggagtgcctccgagggccctgcaggctgcctgagcaatatacaacttcttcctcattcaagcggaacagtcaacttagacttacaagaaaaactttcaaaacccccttttctgtttaggttcagagtagtccacatcagatgaaataagtcattggaaccatgtctactggcttctcctcgtctcacttcaggttcctgtttctcagaccacaagtccattcccagggtgggacactgtgggtccagaaaccatttgcaaacgttcctagtggagcatccccagctccgaacagcagagaagaccagaacttagcacagctctgataaccagtcttgtcctacctatggaaaatccagctattgccagtgggtgtgtggggtgtcctaaaacatgccagccttcgtatgtgatgtggacaactcgccatccactttcaggtgtttccccagtggtagggatgagtttacagagaaccagccactctttcacacgatgcccctatcagccacggcccagtttctagctgtagactctgaggaccagagacctcttctacccacagcgccatccttggccttgtcttgtgcactgaactgactagccctgagggtaagttaacatatgtcaggcagatcacagaaggaactttcctgagtgtaatacaatatgtctaattgcttttcaattgtgaaataatcatacatacaaagagcatgaaatgtgtatgtacaatttaaagaatttttgaaaaattaacaccaatgtctccacaactcaggttaaacattaccagtaccttggaagcccctgagtgccctttcccaatctcatccccctctatccctcaactcccctggcagagacttaatccttctcctgactttggggattatcattcctttgtttttctttatagttttacctcttatgtatgcattcctaagaatatatatcttgtttagttttgcctccttttggaattcatacaaagggaatccaatggtatgtttctttctttctttttttttgaatctcactctgtcgcccaggctggaatgcagtggcaaaatctcagctcactgcaatctctacctcccgggttcaagcgattctcctgcctcagcctcctgagtagctgggactacaggcacatgccaccatacctgactaatttttttttttttgtatttttagtagaaacggggtttcaccatgttggccaggctggtctcgagctcctgacctcaggtgatccgccttcttcggcctcccagagtgctagaattacaggagtgagccaccgcgcccagccccaacacgtagtttttttaaatcccttatccccctcccaccctcccactatccagtcttttttttttttttttttttttttgtatttttagtagagatggg[145 bp omitted]ttatttgtcattacaaacaacactactgtgaacattcttcaggtgcacttgggcaagaacacatgctttttcgcacactccttcctaccttgcaagtccttgtgttttaggaatacctttcccattagaaattagagggagcttgctcccatcagagcatcccagtatggagccagagttagcttgctagtgacccctatggctatttgggacccatgccgaatgagcagagacttgggacaatttagaaacttgtcatatagtggctggggacaaacaaagagacagacaaaaggggcttcctgtgtgtagcccttcccggagactcactcaccctgcacagtgccccaaggatactgccgcgccctcatcatcttgttgcctatcttcagttcttctgtgctgccaatgacagcaaacggcaggtgggcctgaaaccgaaggcaaacgaaagctgagaactgcagaagaaaggcactgagtgttacacaacccaactgctgttcgtctctggggccccaggccctcaccctgcaatgtccctcactgtcatcatcaccaacaagcatttattaagttcccaaaccatgtgaggataagaggcctagtccaagcctctgctgttcagaaattcacaatagagggtaacaatgacatggctgaatgcatagggaacaaagagagaaaataagcagaataataagcagacacacagattaccaaactattcgctattcatagttactgctgaggggaagagcctttggaagaaggggaagtggaatgaggggggttctgtgtggatagagaggataaaggagtaccaaagggtctgggatcactggcccttctccctccctggcatgcaagagccccaagactaggtccatactgagaccacacagccaactgagctgtactctccttgttctcatccttccccggagaaagagctcacattgaacttgtgagcctagaaggcaagtcaccaaggatttactcacatgaccatgctgggttcttctgtaggtgctataaggcagacagaagcagcagaagacacgctccctcgccctctaggagcttacagtcttgttgaggaagcccaaattacataactcaagtcatataagatagtatgtgatcaagggctcaagtatatggtctggtaccctgtacatagtaggtgcttaataaatacttcctgaatggcagtggtagggctagggaaagaggaaagaaaggcaaaggacaaataggtttatgagcttggtgctcacagggaaaatgaggagcttggcctggctttatggatgagagaagagagagctgccccgacttggcagtatggggcctaggaaacactcacagagccgtaatccacaaggagctagccagcttgtaagtgctaagtcaccacagccagatggaaccacggaatcaatgtttactgaccaggtgagcccaggtggggctttgcccaaaagggctttacaccaacaggtaaagagcctatggggaaagtttcttagcctgcctgcagaaacaggccatgatctcagatattctgacccatttgcccactcatccattctacaaatatttactgagctcctatgatatgtgctaggcattaagaatgacgtaatagcaaaaaagcacagaccctggccccggagagtgcacagtgtgccaagggagaaagccatctcaacaacgatcatacaggaagatcagggttgtaccagaagtggaggttgcagtgagccgagatcgcaccactgcaccccagcctgggtgacagagcaagacccagtctcaaaaaaaaaaaaaaaaaaaagaaaaatcaaggttgtaaacagaggctaaagggctggagtaacacagaggagggagcaattcttgggaagtcaaataagttgtttcagagtaggtagtggcaatcatactaacagcattagcattagcaataatttgttaagccctatgcactgggtaccagctgctttacatggcattgtctcactgaatctctacaacactatatggtaagttgccttattagtctcctctttagatggggaaactgaggtccagaagggctaagagacttgtcagcaggcacacaatagtaaggaacagaataacttcaaaccccaccccttgctggtctgctacctccatttagggggttcaagcagtagatgaggtgcgtactctaaaccttggggggaactagttgtgcaagaccagattatcagaggcaattcaattcagggaaacccacagcaaatctgtcgcttgtttgtttaatccacaggctgatctcacagtcaattcttttctccattctcctctagctctggaccccaaaaatgtccttcagagcagaagaacacaggatttcatcaggagctcagctccaggacctccaccagtccctcaaattgcttggccgccagctgaagctgctcttctttcaccctctccactctcagctgctatcagacgatcgtctcagacaccctccgacccctccccactccactgactgtcccttaaatctggacatgggaaagaggaggttatggattatggaaggtgggtgtggggtggaggtgggaaatgtttcatcagtcctgggaggggaatgaccaaaagagtaactgggcaagtgacacacagggcatttgggaagcactgaattcctgaaaatgctgcccaagggcctaagcatgtccaatctttgccaggagagttgatctgggcacaattcatccctactcagggacctaagacatatcgggagcctcgaatccacccctaaacactttctgggaggacatttcccctggagagaccccacagcttcagccacatgacacagaagagccaaggggtggcgaatgcagagagctagactgagggaggaggtgataaagaaaaaccacgttgtagcactccctcctcctgggctctcagctgtaagtgatggaggaggaaggcatgtgaattgggaggtgcttctctgagctcgaggaaaaaaaaaaccaagaagaaaacaaaggcatacaaaaatgtcagtattccctcgggcctgttgcatttttaccatcaagagacaccgtcagaatgatagggtgacttgcttccccctctttctcaaactgctgtcattttattcttctagctcaaaaacatagccccagccctcccacagcacgctcctttgcagctggcgtcagtctgctttgataagtatatgcaaggtaggcatttcccagcgctctcctttggtttgattttcacaacatccttctatggcaatgattaaaagatccattcgtgagctgagggaactgggatacatggaggttaaacgagttgcctaggtccctaacccccatgcccagatcctctgaagcagcagcgaggccaccgagctttggctgccaacctctcccagccacctagggtggtccgcactctgcctcctggctacatggcatctgctagaaggaagcaaaccatgacaagcaggaaatcatggggaccaggctctggccctctgttccactgcttttgagagacagatggctttgacaaccagaatagagtcgagcagagcagagagcagatacccaccctccccccgcaccaccacggaccatacttctaggtcctaccaatgggatccaaatctgaggccaggctttctgctatttttcccaggtctctgcaggaaactgacagacagtggtgacattttctatgtgtggacccagggaagagactctgatagatgcagggcagtgttgctgctgaaacacaaacaggcctctcaggagagtctgtgtgactctctcactcagacttccaatgaggcgccctcggatatcagatttcccagtgtcagaaaactccaacaagagatagtcgcaagccttccttgggagtccattcctagattcaccatctgtcttagtgcattttgtcttgctacagtaaactacctgagactgagtaatttatcaacaatagaaatttattcaaaaaaaaaaaatttattcctcatagttctggaggctgggaggtccaagatcaaggcaccagcattctggtctggtgaggaccttcttgccgcatcctcacacagcagaaggacaagc[138 bp omitted]ggtgaaacctcatctctactaaaaatacaaaaattagccgggcgtggtggcgggcgcctgtaatcccagctactcgggaggctgaggcagagaattgcttgaacctgggaggcggaggttgtggttagccgagccaagatcgcaccactgcactgcagcctggccgacagagcgagactccatctcaaaaaaaaagggccttcatcccattaacaagggagaagccctcatggcccaatcacattttttttttttttttaagatgagagtttcgctcttgttgcccaggctggagtgcaatggcacgatctcggctcactgcaacctccgcctcccgggttcaagcgattatcttgcctcagcctcctgagtagctgggattacaggtgcctgccaccacgcccagctaatgtttgtatttttagtagagacaggatgtcgccatgttggccaggctggtcttgaactcctgaccttgggtgatccacccgccttggtctctcaaagtgctgggattacaggtgtgagccaccgcgcctggccaggcccaatcaattcctaaaggccctacctttttttttttttttttttttgagacggagtctcactctgtcgccaggctggagtgcagtgacgtgatctcagctcactgcaacctccgcgtcccgggttcaagtgatcctcctgcctcagcctcccgagtagctgagactacaggtgtgtggcaccatgcccagctattttttttttgagatggagttttgctcttggtgcccaggctggagtgcaatggcgtgatctcagctcaccacaacctccgtctcctgggttcaagcgatcctcctgcctcagcctcctgagtagctgggattataggcatgtgccaccatgcccggctaattttgcatttttagtagagacggggtttctccatgttggttaggctggtcccgaactcccgacctcaggtgatccacccgcct[135 bp omitted]gcctcccaaagtgctgggattacacgtgtgagccactgcacccagccccgacctcttaatactatcatactggccacacctgaattttggaggggacacaatcaaaccatagcaccacctttactgacttgtgtctaacttaaattcttcttgtacattgtaaagtacttaataatccaattggcgtgagttactttattcttatttcaccacatccattatacttgggaggctaggtgactgcttagcccagtgaaatacacactgtcagaactctttattcctcatctaatgataatattctgattgggcttggtttcctcccagggtggacagtgtttcccagttatgttagtccccatttcaggcccctgctggtgactgaacaagaccattggctgatttgctctcaagtcaaccactggtgattcctgtaaaagtacatggcaacaatggaaataccattgctgtctcagaggaagggatggacttgtgcctgtgggtcttcctatgaccctactgttcagccatgtgttctcactgggcccaaatgtcaattgcctttgtgggaaccaaaccccagacctcacaaatggacaattaatggagctcagtcaattaagtaactgggcctttttgctggtcctggccatgctttcagccattcaaagaacatcattaaatttaaaataacatagcaattcttagtattaaagtctacaaccttgagagatatcagagcatgggttgaaaatagcatgcaacaagacctcgctctcccttctcttccccctcaatctacaataaggttttctggagccacccataattcaaggtggtggcagggacctcattactctcatttcctgccacaaaaatcccccatggtgagagacaggacattgtacagtcttctccactcaggcaacagatttcttccgcttcttccaatccagctcctatgacaattggctggggtggctgaggctgtggggctggagtcaaatccaaaatgaaagaccagcaccaattcctcctaccacccaagcccaggtcctgaggatgcagcttcatacaccacggcttgtgtgaagactctggggacttttgacatagttgttcggtggcaggcaggctaagcaatcctctgtgtatatttgatagcaccctctttcccatcacagcgcatgtaacacaaaacactcacatgcaagctcctctcacaggcatgccaattcaggcacactagctgtgaggccactcctctctttcccactcaaaaaaaacccatagtggattagccgggcatggtggtgcatgcctgtggtcccagctactcgggaggctgaggcaggaggattagttgaacccaggaggtggaggctacagtgagctgaaattgattgcatcactgtactccagcctgggcgacagagtgagagcctgtctcaaaaaaaaaacaaagcacagtaggatgcaagggagtaagtggtgagtgatttatgatagggataatcctgaatccactggaattccctgctcctctcctctcctcccctcccctcccttcctccattccttccttccttccttccactggaattccctccctccctcctcccttccttccttcctttttatttctttctctctttctctctttatttactttctttttctttcctttcctttctctctctctttttttttttttgtgagacagggtgttgctctgtcacccagcctgcagtagtgcagtggctcgatcagggttcaccgcagcctcaacttcccaggctcaagtaatcttcccactttaggccacccaccgaccaagtagctgagactacaggtgtgcgccacagcaccagttaattttttcttttttgagatggagttttgctctggttgcccaggctggagtgcaaaggcgagatctcagctcactgcaacctctgcctcctgggttcaagcgattctcctgcctcagcctcctgagtagctgggattacaggcatgcgccaccatgcctggctaattttgtctttttactagagacggggtttctccatgttggtcaggctggtctcgaactcttgatctgaggtgatccacctgccttggcccccgaaagtgttggaattacaggcgttagccaccgcgcccggccactagttaattttttttaaatttcagtagagatgaggtctcactatgttgttcagcctcgaattttgtttctcaaagtgaaacacaattatgagtaataaaggacccagaatcccttcacagccataacagcatgcttgacaactgctgctgcctagcttgggggtttccagccttgaggttgagcctaccctaggcttagcaggaggccagagctgagctgagaacagagcccaggatgattatcactcctaatccatgaggtaccaagatgtggttctgtgtgacaccttgagatggctgagtactctcagtccctatttattcttagcaaagcaaaccacaagcctgcaagctgcttgatgacttagggcatcagtgttcagaaggtctctatggggactgatgtcctgaggtgactagacgcttccagacatcagtgcccgtggcacccagatgacacttctcgcgaggctcccgtttttctgcagactaggctgtctcttcataacagagcctagtttccatcaaaatgccctgacttctcgagaggacaagtgctaatcttttttattttttccatgcccacggccggtcagagaagacctatctctacctaccatgctccagatagccttacccttgagccagatttgtctaagatggtgatggtgataacaaacacatctcgggtgtactgatggacaggaagtcaggagagacaatgacttgctgccctgctatgctaatttgttggccaattcataggaggtggcagctgaagttgtaatgataacttagagggcagtggcagcaggaaagttttctaaaaatggcttttattacaaggctttcctgagtttggctatacccaggcattatgtcattaggaaaaactgatgacactcaatagagaaaaagaaatctgttcctaaagcggaggctttctgaaagctattagctgtctccttgaaatcacaacattgaagatttcacagcaacagcaacacattgtaaggaagcattaggagatgtttgcatctctgccttctttattactcatttctctagtaggagaaagtgggggaggagaggaaagatggcaaggttttttattattattattcattcacacttaataaagcaaagcataacgctgatttttttttttttttttttttttttgagatggagtctcactctgtcgcccaggctggagtgcaatggcgtaatcttggctcactgcaacctctgccttagcctccagagtagctgggattataggcgcacaccaccacgcctggctaatttttgtattttttagtagagacggggttttgccatgttggccaggttggtctcaaactcccgacctcaggtgatctacccgcctcggcctccaaaagtgctaggattacaggcgtgagacaccatgcccagccaaccctgatatttaaaaataacatatctcggttgcagtgagccgagattgtgccactgtactctagcctgggcaatggaatgagatcctgtcttaaaaaaaaaaaaaaaaagtaaaagaaaaaaagagttgactacactaagatggatggtgaagatgttttgctgctatttggtaaaataataataataataaaggggtcagcgtggtggctcacacttgtaatcccagtactttgggaggctgaggcaggaggatcgcttgagcccaggggttcaagaccagcctgagcaacatagcaagaccccgtctctacaaaacattaaaacattagccaggtgtggtgagtgcacctgtaatcccagctacttgggaggctaaggcgggaggatcccttgagcccaggagttcaaggctgcagtgagttgtgatcacaccactgcactccagcctgggcaacagagcaagaccctgtctctaaagcacattaaaataatgataatcatcataaaaagcaaatggtcaggaaattgctcccactcacgttcatggttccattgatctctgccaccgactcatcatctgtaggaaactgatagatctggactccgttgctgacaagctcgctggtgattttgattttgaactttgttagctcactcttcgaaatggcatctgctttggcaatgatggggatgatgttcacctagggagaggaggggcaaagtggggtcattgttggtaacctgcaactgatagcagcatgacctaggacttccaccagctgccagagggagccgctcagcccagtggtcaaagactggccacttctgtagccaaatgacaatataataaacgacaagtactaactatgtgctgggcactgaactaagtgctttacatgaattagcacaattaatcctgacaataacccttccaggaggtattattactactattttgccaatgagaaattaaggcatagggaggttaagtaacttgtccaaggccatggagcaggtaagtaggagaactgggattcaaatccaaactcagccttattcctaagtccatagtcttaagcatgagctgtctaccagttcagatccaagttgatgagctgtatgttatcttggtatcaaggttactgcttgggagacttgaagcagaaaggtgatagctgggaatctgtggctgacaggggagaggtggcctcttcttgctaagagtaaattgtcccaacccatcgggtctagtctagcccaagccgggtgtgatatggacccacatgagagatggcagggaaaggaggcagggacagtgctcagtgaggatgcacacctggctctctttctggcaggagacactgaataatcaactcagttaggtgaggaagaacctatagttacaatttgatctgagacttatgcaaaaagaattatactgcctgagtctcatgattaatttctgagtaagaaaagcaagtataaatgcccaatttcaggcatcaggagaaagaactaatcccaaccaaaagttcaatccacctgaaccctaatccttgaaattcctccaagaagggacaaggcttttactgtcagaaggtaaagaaacttgaaatgcacatgtgtttgtgagacagagcacactaagttcaggttgacatggagagcataatcattcctgccagtagactccaacggggggtgggggaggggcataggtggcactcaggccccggactctaaaaggggagtctgggagctccagacgtggaagaaaaatcctgcttcctctgcgctttggcttaggagtgcctctgaaggctgatatcacacagccgctgggtcaaggaaagactgaaccgtggaggcacctcccttgaagtctttcaggggcagaagggtcaaagcccttgccaagatgaaacagcaggcagagcctattctccttggcactttcgccaagtccccattgacacactataaacatatatcaggccaggggcagtggctcatgctgctaatccaagcactttgggaggccaaggtgggcagatcacctgaggttgcgagttcgagaccagcttggccaacatggtgaaaccccgtctctactaaaaataaaaagtatccaggcatggtagtgcatgcctataatcccagctactcgggaggctgaggcaggagaattgcttgaacccaggaggcggaggttgcggtgagccaagatcgtgccattgcactccagtctgggcaacaagagtgaaagtccgtctcaaaaataaataaataaataaatatatatgtatctatctatctcaaaggcttaactcggcccatccaccaggcctgcagccatgtggctcaccaatgcccctatacaggacatgcagggcatggccacatttcaagagcagccttttattcatgggccatgagcctattgctgcaaaaaatgaaaaactgctcctattctgatgagagctgaaattcagtcttagagtggatgtgctactaaatggctgcatgtgaattcgattatttttttgatacggagtctggctgtgtcgcccaggctggagtgcagtggaatgattccagctcactgcaacctccgcttccaggttcaagcgattctcctgcttgagcctccccaatagctgggattataaatgcgcaccaccatgcccagttaatttttgtatttttagtagagacgggatttcgccatgttggccaggctggtctcgaactcctgacctcagatgacccgcctatcttggcctcccaaagtgctgggattacaggtgtgagccaccgcacccagccaagtttttcttaaaggaagacaacgcctgattcccacagccatctttctcgggcatggaagcattataacatggggtcacagatctgagtgtcacagaatctgcactctaccagtagctagcaatatgacaatgagcaagtcacttaacctctgagagcctcagttttctcttctgtaaaatgaagataacaataatgtgtacttcacggggctggcatataatgagggttttaatgttaactgcaatcataaaagtaattattgatagcaagaataactttcaaagtcaagtttgcatgtttgattctagccagttaacattcggacaaagaaaaaaacagctttccattgccaaagcctttgcccctagacccagggagccatcttgctagtccccaagagggatcagggcagaaagacagctcagggcaagcccatccctagtgctgggaaaacagatcacaaagcttacgacgctggtgctggatccgtaacaccatctttatggagggacagggaatgagggagaggatgaggatgccacaaatctctcccggaatcccacatctactttgcacaagagatcagtaagagtgagcccccagcgcccccgcccctgcctcctataccttactgtccagcttcttcatagtcactaggtccagagacttcagggaatgacccgtgggggcaatgaaatacaagcagacatggattcgggagtcatggtaggtgtgtagcactcttcggatctttagctcttcctgcaggtaggcctcgaattgtgcatcgatgaattccacgataggcttgtagctaaaagggagagcagggacagaggcggatcccgtcaaaaacttggattttgacaccgtcctttttggaagtttcaaatgccctctgtaatcttgactctctcccatccaactgcatttctccatctcccttcagtgggcctccaatcttgtcagcctggccaccttcttggtccctacatgagccaaacttatgcccatctgtgcaccttcactagaatgcccctttctctctcctcatcccaattctgccctcccagacctcagggctcagcttaatgtcctcctccttcctacggccttccccacttatgccagaaatcccttctgcgagtcaggggcataacaagaaatggcattcaattacttattgttgcttcacaaggattctctcaaatagattgtgccttcctaaagagcagggcctgtgaagggcacttgtctgtccctcggggggccccaacacagcatggagcccactggctgtatctgtagagggactgattttcctccaagctgggctcatgtctttgctccctttatctcgccctacagtgcctagatgagagctgggtacacagtgggtaacaagacctctctttggcccactgctgggcaatcttgtgagaacattcagggcttttgctcattctcgctaggtttagcggagctccacacttggctcccccaaggtcaagatatttttctgattctcatttctgccaaggtggtgactttaagtattcaggccaggcacagtggatcatggctcgtaatcccagcactttgggaggctgagacgggcggatcttctgagctcaggattcgagaccagcctgggcaacacggcaaaacttcgtctctactaaaaatacaaaaattagccagctgtggtagctcatgcctgtaatcccagctactcaggaggctgaggcaggagaatcgcttgaacccggaaggcagaggttgcagtgagtggagatcatgccactgcactccagcctgggcaacagagtgagaccccatctccaaaaacaaacaaacaaacaaacaaagtattcaggcaaaatctggtaaagctactcccctccgcacaccctgcacacatggacacaggcccgccagctcactgagtctccacacgcggctcctctaggtggcccccaagtcttgccaaggcttcttaaacaacagtcagccctctatgtctctctttcctgggcctccctgggaaacttccctctccctctgtcccagtcccctcccacgtcatccccgtcacccctacggcctctttctgctctaactaggtcagcttagctcagctctgcctcttgttctcatctcccctgtctgtctgctgcctctctggctgagggggtgcctcccttcaggctagaagaggcttgtcatgtgggcccagggcagggagttttcagataccgctgccagaagggaacatgatgatcaaaggaggagctgagcccagccaatgcctcccacctgcagcagctcccaggctgagcctttctgaaagatccccctagtagagaaggggaaaatagccttttaagaaagaatcacaggatcctagattctgagagctgcagccagagctgagatccaggtgcaggctatctctggagccccagagaaaaatctttttttttaagatggagtttcgctctgttgcccgggcaggagtgcagtggtgcgatctccactcactgcaacctctgcctcccaagccccagagaaaactctaaaaacatagtcctttctttattcctttgatccctccgagccactgttccgaagggtaatcgcatcaaagaatctcttggttgcaaagatccttagaaggttcctgacgaatttggagtgagggtggggaatgtatcccctaggcttatttaattaatttttggatgttttgctgatttgaaatagttgatgatggcactgcttcattttttttctcaattacgtaatttttttttacttcattttttgctttgcagaaggaatcagaggaaagaaaataaagctaaaaagtgcattttttagctcccccacacaccccgaaatctgtagtgataccctgtgcctgtcttactgcaattgcctctggctctcggaagctctcaagatgtacatggatcagaccagccaaaccagccaatcagccaccaggatttggtgtagacgaatcctaaatgggtggcttatcttcgtcttattcatctctgtatcctccacgtctagcctgctgtctggaacatagtaaagtttccgctactgctctgcattccctccacccccaggccccagtgactcatcttcccacggtggccacctctctcccacactctgttgtgctgctcactggactccagtgggtggtaaacaaaatcctttactcttataggctacctcctcccaaactgcttccttcctctaagtgacacctgactatccttcagagatgctgcttttctcatatccttctcaactggaaatttcttcatctccacacccaagtcccatggaagggcagagagggcagctttcttctagctcttgattccctcgctcactgtgatctcctcatctcctccattttcgaccaaaaccagctccaacagactccatccctccccatcactactgataatctttgacatttcaagacagccgttcttaacacagggttcatggacctcctaggttctgtgaatagaattcagaggatctgtgaacttagataggaaaaaaatacatctttttcactaatctctaactgaagtttagcagtttcttcagctgcagacataggtaacaatctatagtaatgttagcagtacctgtgatttcataaccaatagaaatcactgatatcatcatttcccattccagttgttgtaaatagctcaaaatagcatttatactcattacaacattcaaattctggtaattattaagcctgcatatagatattattacttctggaattgatagagaagcacatggattgctaagtcacaatttttaaatattttagtaactgtatttttagtatacttggtatattttaggcatttaaaaacattattttgagaatgagcccataggcctcactagattgctaacggggccaatggcacaaaataacccctggtctagacaataatacttattcatttcggataatgatatgtactatgaagatactccaataggataatgggatatacatgtgattgagggttcaactactttaaatacagtgatcagggaaggcttctctaagggtgtgacatttgagccgcaaggatgaggatgacagagccatggagagatctgggtgaagagcattccaggcagtgggaataataaatgtgaggatggttctgaggcagaaaccagtctgacaggtttgagcaatgggaagacggccagggaggtgggacttggtgaacccagcttgagtaaattattcacagtagcccaaaggtggaaacaaccca[134 bp omitted]cagggtgaaaccccgtctctactaaaaatataataattagctgggcatggtggcgtgcgcctgtaatcccagctactcagaaggctgaggcaggagaattgcttgaaccgaggaggcggaggttgcggtgagccaagattgaggcactgcactccagcctgggcgacagagtgagactccgtctcaaaaaataattaaataaataaaataaaataaagaaaatgtgaaaatgtggaggccaggtggggtggctcacacccataatctcagcactttgggaggccgag[132 bp omitted]gaggcaggagaattgcttgaacctgggaggcggaggttgcagtgagccgagatcgcaccactgcactccagcctgggcaacggagtgagattccgtctcaaaaaaaaaaaaaacaaaacaaaaaaactgtgccttatttcttagtatctctgacacttcacactgtacttgtcacatagtagacatttaagtttataaagtggactaggtttccacggcaacttggttctcagtcttgtcaattctctcaaatctgcccctcctctctatcctcaaagcttctcttcctgttcaagccctcatcatctctcccatcctcaagagttgcccctgacctccttgtccccctctagacatggccttgtgtatttctcccagctcagacaagctttcttttttatctattttttagagacgaggcctcgctctattgcccatgctggagaacaatggcatgatcatagctcactgtgacctcgaactcatgagctcaagcgattctcctgcctcagccttctgagtatctgggactacaggcacacaccaccacacctggctaattttttatttttgtgtagagacggggtctctttatgttatccaggctggtcctgaacttttgggctcaagtgatccttctaccttggccccacaaagtgttgggattagaggtaagagc[229 bp omitted]gaggcaggagaatggcgtgaacccgggaggcggagcttgcagtaagccgagatagcgccactgcactcccgtctgggcaacagtgcgaaagtccgtctcaaaaaaataaaaaagaataccgattcttccttcctcacagataacctctattttcagtttgctgattatctttccagacctttttctatgcatctacgcacataaatagagagaaatatttgtggttttattggagggaggggggcagatttacagacaccgcatcgtgatcattctgcaacttctttttttcacttaacaacatatcctgagatctagccatgtgagtatatatcgatctacctcattctattaaactgccaaacacaattccatggtatggtaattccacagtttatttaattgctctgttggtagaaatttagactgtttaaattgtttttcattcaataaccaaagctacagtgaacatgctttctctatgcttctcaggagcatgtgcaactgtttctctaggctgtatacttaaaaggtggaactgctgggtcataaattattcacatttaaaattttaatagatactgccaaatttgccctccaagaagtctatatcaatttacagtcccatcaacgtgaatgaaattacctcgtgttagtggatattataccatccttttgtttttgcagatctgatggataaaaaatatttgtttcattttgcatttctttaattactggggaagttgaatgaccatcatttcatatgttgattgtacataagtatttccccttctgtaaattatttgtttatttctcattgaattgtagaagctctttttccattttagaagaatcctttgtctgttatttaggcagcaaatatcttctccccatctgtagcttgtttgtacttttgtttatggtatctttcaatacaaaagggttttttattttaatgaatttaaatccatcagtcttttcttctatgacttttgaattttgtgtcatgattggaaaagccttctctacccccaaagttataaaaatattctctgatgttttctccttatatttttagaaatctgtttttagtccaatgggaatctatttttgtgaatggtgtttgtgtgagagggtctcgttttatttttttcctaaatagatggcctattttcccagcatcatctcctgaatagtccattcttcccctgctgacttacatatgctaaatttccatatgagcaggaatctggtcttagactgacttttctgttccattgctctttttgctcttctgatgcctttacatgcttactttccattcactcagcaatcacggtaatctggcttccacccacagttcccctcgaattattattctgaaatgtattactgaccttcatatcaccaaacccaaagaatattttgcagttctcgtcttcctggataccatgtatcattccttcccatatactacatgatttagctgttccttgattcttctatcaataaaaatcatgatcataatatcttcagtttatgaggcagttactctgtgccaggtgtttaagcatttcatattccacacatgtcaaatgtgcttcaccacaactctctaaggtaggtagtattattattatcatccatcattatcatccccattttacagatgagaaaactgaggcatagaaaatttaagtaccttgttcaagatccctgggctaaaaagacagcaagatgaaatttgaacccaggtctgagaccaaagcctaggttcctaagcactcccctctccagcttgtccttctcagtctctcccttaaatccccttttctccagcatccttttttatttttattttttgagatggagtctcactctgttgtctaggctggagtgccatggcgcgatctcagctcactgcaaccgccaccttccgggttcaagcaattcttgtgcctcagcctcccgagtagctgggattacaggcacataccaccatgcccagctaattttttgtatttttagtagagacgggggtttcaccatgttggccaggctggtcttgaactcctggcctcaagtgatccacccaccttggccttccaaagtgctggaattacaggcttcagccactgtgccctgcctccagcatcctttaaatggtagctttccgcagtatccggccttagtcattcctcttcctagtttatgcatgagcccttgtaaagcgggatattctaatgccttgtttcaatgatgcttcactgacatatctatgctaacatggccctaacagcatgaagaaaacactgctttttattacagatccctggagcttactccacccctgctcctcagtgcaatttcaaggaggcttttcatttctacttatttgatttattataagtatgtatcacatttataatcgggaagaaacaatagggatatcttaaaactataacggaagtagatttgcctctgaggcgcagtatctgttcagtcctcccaagccattattatcaaggcattgtccaatgttagatatgttgaatgtatgtaactgaaagaactgtaagaaatgtaattgaagtttctgagcaatctgcagctgagattaagcactcatattgtggcccaaatatcctttctccaaagtttaatttattctcaaccaaacaagattagcacaataagcatgcctataaaaagcagaggtggccaggcacagtggctcatgcctgtaatcccagcaatttaggaagccaaggcgggggtgagcgggggggatcacttgaggtcaggagttcgagaccagcctggtcaacatggtgaaaccccatctctactaaaaatacagaaaaattagcagggtgtggtggtgcgtgactaattccacctactctcgggaggctgaggcaggagaatcacttgaacccaggaggcggaggttgtagtgagctgagattgtgccactgcacttcagcctgggtgacagagtgtgactccatctcaaaaaaaaaaaaaaaaaaaaaaaaaaagcagagatgtcttttttctagaatttcaaatgcaaaacagaactcagttccattattaagaagctatatatatttggctgggcacggtggctcacacctgtaatcctagcactttgggaggtcaaggagggtggattatgaggtcaggagattgagaccaacatggctaacacagtgaaaccccatctctactaaaaatacaaaaaaaaaaaattagctgggtgtggtggcacgagcctgtagtcccagctactcgggaggctgaggcaggagaatggcgtgaacccaggaggcggagcttgcagtgagctgagatcacaccactgcgctccagcctgggcaacagagcgagactccgtctcaaaaaaaataaaataaaataaaaagaagctacatatatttattcattataaggaagtgagtgtggctgttgtagctttaagggggaaataaaagaatttgacataaagttcacctaagaagcaagagaatcctgaaagaatgagaagaccctctgcttaaaatgatgaatggccctttctgaaatgagcacatgtgataaccatgtgacttctggttaaatgcagatggtacctgaccccacccctcatcacattcccatctctgagcctcacctagtcttcactcacacacattctcaaccccctacatctttctgttttgttttgagacagagtcttgctctgccgcccaggctggagtacagtggcgcaatctcagctcactgcaaccctgcctcccggattcaagtgattctcccgcctc[223 bp omitted]attcctgttcagtcccttttcaggatgtcttttcctccatctattgacttagcatcctgaggtttttgtctttagcccagtgttcttcttactctactctgatccctgggtgattttacatgtgtccatggttggaacatatcacctctaccttgataacccaatctatttctagcctcttctcatctccaattctgtgtgttcaactgcctactgctgaaggtcatcgcgtatctcagtattcctcagacagatcaaacttgacatgtccaaaacagagctgattattttgaaccctggttctcttacggaatgccatcaccatgtgtccactctccaaagctggaaatttgggcctcattctagatttttcttttgccttcacaaccccacaccaagtgcctaccaagtcctgttgatatttacctactcagtatttagcaaatctgtctcctcttccctatctcagcacctattttacctcttgccttgatcataaatccttctgtgatctggcacctgcttacctcttcagcctcatctcaccgttttttccccaagcttactccaagtgttagcccaggggcagaaccaggtttttccagcccttaggcttatgcaatctgaaagactctctgaggaaaataatacgacattgtgattgaacattagttacagagctttggaaggggcctgtgcaatcttcattagcttcacagtgactctgcctctgtctagccaaagagagcaagctacacttccctagaacataccagaatcctacacatcactttgcctttatacaggcagttacttctgcctgagatgcccctctctccattcccttgtctgtctggcaaaacagttcgtccttcaagagtcagctcaggaggcacatcctttgtgaaggcttccctgacctccctacgtggaattgatggttctcgcctttgtgttctcattgtaacttgtcctttatctctttgtaccctgtcctttacagaacatcttatactctatggaaattatttgcttaaaaccggttttgcctatgagtccctcaagggcagagactaagccattcctttttagatggtcagagctcgacagtacctggcgcaaggtaggagctcaataaatgtttgctgcatggaattgagacctgacccatgtatactagaaagacacccttcttttggcaaagtgagtggagtggaacagttgctgtagacagggacaccagacagggcctatgcttgggaggtacctgctgctgcccacaccattctgggaggacaggcttgggcccgatatctgtgctgtcttcaagatctctgtggtgagctcctctctgcggccctctaccaacctccccaccctaccccaccccaccgccttctttacctgtcctctttgttgatctggtccccaaagccaactgtgctaacgatcgtgagctttagcctcacgttgctctcttggaggtcataggtattagactggagctggacacccggctgtgtgtgggtggctggctccccttcgaatttggtgttgaacagggtgtccatgagggtggacttgcccaaacctgtctctcctgaaaagcaaaaggataaattatggtctgttcacatagtgactattcagcccttacacatcatgtttcatatacacatttgttgacacgggaaaatgaacatgataaaacataaagcaaaaagcagaagcagatgaactatatgatgtcagttaaatgaaaaagactgaaaggaactatacagacggatcagtagtagtcatctcagatagtagaattgaggtaattttcattttattcttccaacttttttctgtcatttggaaattttaccttgagtatacattgttttttttgttgttgtttgtttgtttgtttgtttttgagacagagtcttgctctgtcacccaggttagagtgcagtggcatgacctcggctcactgcaacctccatctcccgggttcaagcgattctcctacctcagcctcccgagtagctgggattacaggcacccgccaccgtgcccagctaatttttgtatttttagtag[138 bp omitted]aaaaagaaattatgttataggcagcaatggagagatatagctatgcctagaaaaaaagactgggaggaaatacaatatactcttaccaatggctatctctgagtggtgatcttatgtgtggttttcatccctttctttatgcttttttatatttcccaagttttctaagtggaatatgtatagtttttgtcataaaaattagaggactattttaaatttttttaaaaaatgacagcagtggccaggcgtggtggctcacacctgtaatcctagcactttgggaggctgaagcaggcagatcacttgaggtcaggcattcgagaccagcctggccaacattgtgaaaccctgtctctaccaaaaaatatatatatacatacacaatttagccaggcatggtggcaggcgcctgtaatcccagctacggaaaggctgaggcaggagaattacttgaaccaggggaggcagaggttgcagtgagctgagatcgtgccactgcactccaccctgggcaagagagtgagactccatctcaaaaaaaaaaaaaaaaaaaaagacagcggtcccttgtcaaacaaatatcctttcatcccagtccccacctctcctccctgccaggcctaaacagccctctggggatgccccagatgtgcctccccacggtgaaaactgtgcaggctcctggcttatcctcccagcctggttgaacggttgaactttcagtgagaccgtttttaactaagaggggcggggtggggagacccagcaggccacaaaaattcttcttcttcttcttcttttttttttttttttttgatacagcgtctcgctctgttgcccaggctggagagcagtggcgcaatctcggctcactgcagcctctgcctcccgggttcaagtgattctcctgcctcagtctcccaggtagctgggattacaggtgcctgccaccatgccctgctaatttttgtattttcagtagagatggggtttcaccatgttggctaggctggcctcaaactcctgacctctggtgatccacctgcctcggcctcccgaagtactgggattacaggcatgagccaccgtgcccggcccttatccttaaattttaaacaaactagccatttatttgtttaactactaggctgcgagatactaataagtcaaactgttggaattttaaaagtcttgaacttcacactagggaaaccagtaggggaaaggctgtggcagactggtgaaggttttggaagcttattcctgggagatcaagggataccaagccactgtcaggagccaacaagacttcagggaatgggacatcacaagaagtcaggagttggtgacaagggggctaaacaggaatctgatatgaggccacaaactgggctgggcgctgcttataatctctacagatccaggctgtatttgacccctcagcccacccc[187 bp omitted]gatggtgggtgcctgtagtcccagctacttgggaggc[136 bp omitted]ttcgaagagaggatatcattaattactctggcctgccctttgaagacaaagactactctcccatttattccgctatcatcatccctgtttttccctctcctctccccaacccagggggaatgtgagcctcgacttctcttcacagtcgggactgggtttgcattgggcaaattgtggcctgccaaaccccgccttgcgaccaaaagcacacatctgcagggtggttcagggctacggttagagctacatgatgcagaactgaaaatgctccatctcccctccccactctgggtgtgtctagcctgcttcttttatcccaaataatgagctatgaatgcaggaggtgccttttaaaatatctgtgtatgatgagagttttctgtgtgtggacagagagaagggagagagagagaagagataagagagaggagggagacagggagagggagggagaacaaggagaacattcaattcagtctggctacccggccccccagcccaatttcatagccaggtctgactaacttggtaaattgccagagtgtggggaaatggttcctcacacagatcatgtttcaagccagggtctgctatatccattagcagcaaagactcttgaagaagaggccccctttttcctcccctaaaggaacaggaagtatttgggtcccaagaagaattttatgaggtggggcctttgccatgggaggtggcagacttggccaagcagtggaatgtatcacaccccacctcacccaaagttggggtgcaccttaactgcaaacggggccagcaccttggaggtgggaacacagtgtggctcccacatcctaactcacctcccctctcgagggcactgaggtttgagctacagtttagctcatcttcctatgtgcctgatgaattttccatgtacatccttacccccaactccctcccatggaacagaagggagcacatggaacagaaccatccttacccccaactcccaaaacccttctgttgcatgagctccctgccgaatgccctgtagctcctagggagtgggggtcctgtttccccagcacccagagtgggcaccctggctccccgatcctaagaattctcagagagcaggagatgggccatcttccagtacccccgagagtgcctaacccaaggttcacacagaaggcctcaggggcagcaccgcagcgttgagggacccaccctgtttgcacagctggaggaatgggggccgggcagggcaggacagggagctgggaggaacagcaggagaaatgaccacccaaatgcctgctggcacaaaagcgctgtggaaattagatgccaaataatgaacgtctggaagaaaagaacacccgggtgtctagggaattgagataaatgcaatagtagagagggcagaaaatcaagcgagctcatcctatggctatcgagagctcctgttccagttttccatcagtgtagagcctgggggtcggggaggctttctgtcaatgactggcacagacccagcctgatcctaggatgctgcccctcccacggctgccctgggcccagtactgagtgtgagtgtgttgtgagggggaggcacacgtgacctaactgggatcaggtcagcagattccacacccctgcaggaaggtggagacttggcaattcgattccagcaggaaacctgaggagtcccgaggggtcaatttctcactcctcctcccccagccctcccagggctcctccaagtggatagtaaggtttttaacgcatgctccaccagccaagaggatttcatctcactttgcttaatgtagatagtattctggaaacaatagttttaaaaaaaattaaaacatatatgagtactacgaaatatgttttttttcaaactatgctcttgcgggacggtggctcaggcctgtaatcccagcactttgggaggtcgaggcgggtagatcacctgaggtcaggagttggagaccagcctggctaacatggtgaaatcccgtctctactaaaaatacaaaaattagccgtgcatggtggcaggctcctgtaatcccagctactcaggaggctgagggtggagaatcgtttgaacccgggaggcggaggttgcagtgagcagagatctcaccaccacactccagcctgggcgacagagcgagatcctgtctaagaaagaaaggaaagacagagagagagagagagagagacagagagagagacagagaaagaaaaagaaaagacttctagccaggttatcactaagttactttgtgacatgaactgagctctttcccctctctgggtcccagtctctttttctataaaatgagagcgttggtaataacagctattgtttacagacactgctctaagttttttacatatattttcttatttattcctcacagcaagcccatgaggaagatgttactatttgtcctcaatttatagatgggttaaccaagccacttactagctgtgtaaatttgcaccagttcctcagcatctctgcaccttactttcctcatctataaaatgtggaggggccgggcgcagtggctcatgcctgtaatcccagcactttgggaggttgaagcaggaggatcagttgaggccaggaattcgagaccagcctgaccaacatagaccctgtctctgttttattttttatttccataggtttttggggacaggtggtatttggttatatgagtaagttctttagtggtgatttgtgagattttgatgcacccatctcctgagcagtatacactgaacccaatttgtagtcttttattcctcacccccttcccgccctttccccctgagtccccaaagtccattgtgttattcttatgcctttgcatccttatagcttggctcccacttatgagtgagaacatacaatgttcggttttccattcctgagttacttcacttagcataataggtctattttgaaaactagtaataataaaataaaatgtggaagaagtaactagtccaaggtcacaaactagtaagtggcagagccagcatttgaatccaggcaggccgacgctggagtccatgcttttaaccaatgtgctctagcgagacgcataggcgtgatacgtttgttcattcagtcattcaacgagtatttacaaagactctaacaggagccaggcacagttataggagctgcagatacagcaatgaacaagatagccacaatccctgttcttgtggacctaaagtctcttccagttctgaatgttgaacccagagaaacgtctctgagttcaacagggaggtgcccaaaaggaaacattccaggaactccggttggctaaggaagcctatggaaagggacaaggttatgcctggctctgtgaccttgtcctttctccttcctgatcttgcagaggcctggcaggcagtggtgtgctggagccggctcgtccgcttcctgcatctcttcccaagcccacgtgcagtgatgtcatgttggtagcttaacagcagccatggcaggagtaatgacaccaacaaaatcagcagatgcttcaaaccacaacagtttttctcctgagatgggctgtgacgttgaccagcacaccactgctggcagcctgttttagacaaataagcagctgcctttcccagatatgaagggatgaaacaattgatccttggccttgatagaatgctagctgccctttccctcctcctgcagcaagcctcaatcctgcttctcttgtgtgactgtttttttccatgttcaacagagcccaattgagcctggaatcctgagcagcttcaaagtaaatattatcattatgaccctttgtgctcttcacagccatgactgctactgtagcatttagatggatgagtctctttggggcttgttcccaggagtgcaaagcaacgggccccagaatatttgtactgttggctctggtggttcctctgaggcattctgtactgcatctaggatcaggggatccttgaaatttccaaagctaagggactagtatatgtgtttttatggggagaaagaggaacctcacctcttcggtaattatggtcaaccctagagaatatattggagaggagtcataatatgttcacactcatgtgcctagtcctctaaaaagaataataggccaggtgtggtggctcatgcctataatcccagcattttgggaggtccaggtgggcggatcacttgaggtcaagagttcgagaccagcctggccaacatggtgagaccctgtctctactaaaaatacaaaataaatcagctgggcatggtggtgcgcacctgtgatcccaagtactagggaggctgaagcatgagaatcacttgaacctgggagatggagg[132 bp omitted]ttaggttctggattatcaaaaattctcggccggacgcagtggctcacacctacaatcccagcattttgggaggccgaggcaggcagatcacctgaggttgggagtttgagaccagcctgaccaacatggagaaaccccgtctctactaaaaatacaaaattagctgggtgtggtggtgcacgcccataatctcagctactcaggaggctgaggcaggagaattgcttgaacccgggaggtggaggttttggtgcgccaagatcgtgccatcgcactccagcctgggtgacaagagcgaaactccatctcaaaaaaaaaaaaaaatgctctctcttagttgcaacacacatatgtgcacagatgtacacacatgcacacatgcatgtaggataccttgctggatgtaggcctatgatcggcagcccagcaccaagataaacaatagtgtgaaaaaatatcctaggtctttgttaataattgaagctagtgctaccataattttacaccaaaaatgccctatcaagaaaaagaaacgtttgggtatggtggctcatgcccataattccaggactttgggaggccaagtagggaggactgcttgagcccaggagttagggaccagcctgggcaacatagtgagacctcatctctacacaataagtttttttttttttttgagacggaatctcactctgtcacccaggctggagtgcagtggcgtgacctccgctcactgtaagctccgcctcccgggttcacgccattctcctgcctca[224 bp omitted]ggtggcatgtgcctgtagtcccagctactcaggaggctgaggtgggaggattgcttgagcctgggaggttgaggctgcagtaagctgtgatcacgccacagcactccagcctgggcaatagaacaagactgtgtctcaaaagaaaagaaaagaaaatactttggggaaatatattctatgcccaaacagcatcttgttataacagtcattaagggagtaaatgtacacaggcagtaggcatgaactatcatcacaaaaagctctgcaagataaaagatcaccttcagcagctaagctatggaccctttgcgaagtcagtgactggatccagcctcatggctgggctgacattgcagcttcagagctactctaagctacttatgaccttggcccaaattgtgggttctctgagcaaggacagggtggtgagcacagcaagagggcaggatgcgtgcattgcagggttttttggaacaggggtgaaattaacccagtcggggctggcctatccaatggttgcacctgtgagtctaagacaggagctacagaggcagccatttcctgaaacttgacaagtggggagcaaaagagagtctgtgactcttgaggatgagagcatctccttcctactcctcccctcttggagggtctgtgctgggtacttgagcaattccatcccagcaggtgcaagtggaagcatttatagctgtacaatgtctaggtggaaactagaggatgggggattactatttctcccatccactttgccttgagcttggctgcctctgggccctaggggagcctgtgctccacatatcaaattaccctacacttccaccctcagagatccatttcaattcacatggcctccctcctaaagctttactagcccacccaatcgcactggttgaaaggttgcttaaggtggatctgtcatttctcttctcatctcaacttcagtacaggtcatatggagttctgggaagaatgccaagggactctgatatgtttgtgcttaaatattgtggtaatcaaatattatgtgaaataagttggccatcagccaaagattggagctcttgttagttaaacagagatttggcagtgctaacattggatgtgatagtctttgcacttgatgtcgattactgtgacttctagttattttacatttttctccaaatagcacctaatcataaccatcagttagactttcagcatttgaagaattaacagcctagatctggactctaaggccctcgatgtgtaattctgtgaagcacatattttcttttttttaatgtactgttttattcactaatgcctccaggtatatttctctccctatgaacaaggacatgcatagtagaagtcacatcttaaaaataagtttgagtataaatctgtggattgaaactgaagcacatattttcatctgataggttccaaagttgatgtgggccaggcatagtggctaatgcctgtaatctcagcactttggtaggctgaggcaagtggatcgcttgagcttaggagttcaagaacagcctgggcaacacagtgagacctcacctcatctctacgaaaaaaatgagcccggtcgcatgcctgtaatcccagctactttggaggctgaggtgggaggaatgcttgagcctgggaggttgaggctgcagtgagcctctgcactccagcctgggtgacacagggacactttgtctcaaacaacaacgacaacaaaaccaaagttggtgtgtgggagtgagccatttagctagggagtgagcctagcttgtgggaacaactgcccgtcatctgttgttctctacttgtccttgaatgtgtagcaattctcttacaaaaagtgacctggaaaagaatgctggggatagaggaaaaaaaatgataaagagcccaagaaaatgaatgaccttagtgagaaaacagaatttctaggctgggcgcggtggctcatgcctgtaatcccagaagtttgggaggccgaggtgggcggatcacttgaggtcaggaattgaaactccgtctctactaaaaatacagaaattagctgggtgtgtggcgtgcacctatagtcccaggtactcaggaggctgaggcaggagaatcgcttgaacccggaaggtggaggt[132 bp omitted]agtgtaaaatatccaatttagtagtagttcagatctactacatgaacaagttccccatacgctctatacaaaaataaaaggcaattagcaaaagtgtttgagtgtttcagccagtacaaaaacagactttattctggtatttatataatcattaaggttcagaaggtcactggaaatatgcaggtatgctttcccgtgttacagggtgaaaattatatgctatgatcatgtttgcaaatttgagatatttaagatctaagaagattctttttttttttttgagacagagtcttactctgtcgtccaggctggagtgcagtggcgcgatctgagctcactggaagctctgcctcccaggttcacgccattctcctgcctcagcct[222 bp omitted]tttgattggtgctcagtggtttccaaagtgctttcatgtgctcaagagatattgctggcagcagttagagaagcagggggaggaacaaggggtcaaccaggcctgagtcctcattatggtgccacttcttctgtgttgcctcaggtaagtcccttatcctccccaagactctgtgtctccacctgtttcatgaggatacaaatgctacttgctctgctcacttcgcagagtcctggtaatgtccaaaagagctaatgtgagaaagtgaaaagtataatgaatggttcctgtggcattcacccattcattcatttcacagatattaccgcactctacttgtgctgtgattagcaaatagagggggctaagatgcagctcccactgttgagattaaatgtctaggtagaggccgggcacagtggctcacacctgtaatcctagcactttgggaggccaagatgggtggattgcttgagctcaggagttcaagaccagcctgggcaacatagtgagacccccatctcaaaaaaaaaaaagtctaggcagagagataggtaaagggaataaaagaatgttgcatacagctgtgtggtgcctgcacccgagctcaaactaaaccaagcacagcaaaactacagaggaaacagacccaacccactgcccacagctggtgggcaggcgttttttgtcagctatcccctccctcccaattctgccctggatcctgtcttctgtagtcaaaatgaactctacagccatactgagccagccagctcccttacagaatttccactgggtctcacatagctcagtttccccccaagatatggccctatactctgatctggccaggggaaaaaagtaattacagccagctgtttacaaaaaacaggcagagagataaaagaagaggggagagacactctcgcaactaaatcagaatgacacactatttaacctaattacctgcaaagccgtatccagccattaaggatccatattctgtaatagaatttcctgctatggaaatactcacccacgcacaggatgttgaagcagaagccctggctgacggacttattcaccagctggtcaggcaagctgtcaaaccccacatgtccagccagggggacagttcggcaaccttcaccctaatttggaaggagtgagggagaaaatgaaaatgtgcttaaaagcagtctgggtctcgcttctccatccaaatgttcgctgtgcaaggaagtcacacccgcccaggcccagtgtgtcatctcttccctcagctactccctgctccaaagcaaaatggcccgtcagcttggaaatcacagattcttggggacaggcatcctctaggctcaatagtgaatgtcgccacagctccagagaaaattacagaggagcttattaggggcaggagagtggagtcaggggaggagaatgctggcaccgagattcacagactcaggttaaatctccactcagtcatttacaagctgagtaacttgctgagactgtttccttccacatctgccatctgagataatatggcatatcttagaggtgactgggagcctcagaaacgctaatacatgtaacgagcttagtatatgcagaagtattcagtaagtattacgaaaagggtttaaaaagcaattattgggccgggttcagtggctcacacctgtaatcccagcactttgggaggccaaggcgggggggatcacttgaggtcaggagttcaacaccagcctggccaacgtggcgaaaccctgtctctaccaaaaaaaacaaaaattagccaggcatggtggtgggtgcctataatcccagctacttgggagactgaggcaggagaattgcttgaacccgggaggtgtaggctgcagtgagccgagatcacgccactgcactacagcctgggcaataagagcgaaactctgtctcaaaaaaaaaaaaaaatcaattattggctggcgaaatgtctcacacctgtaatcccaacactttgggaggccaaggtgggtggatcacttgaggccaagagtttgagaccagcctgggcaacacagtgagacaacatctctacaaaaaatcaaaaattagctgggcatggtggcatgtgcctgtgtagtcccagctacttgggaggctgaggcgggaggattgcttgtgtccaggaggtagaggctgcagtgcgctatgatggcaccactgcactcccgcccaggtgagagagcaagatcctgtcttaaaaaaaaagcaattgttcctctctctctagagcattttgaggacctacaaaggcagtgtagtgtagaggttaagagtagaggctttgaaatctggcaggtgttagttacagccccatctccaccatctcctggctgtgtcaccctcagacaagttacataaacttcttaagttttccccatccataaaatcggaaactattgagtaggagtgtgaggattatacaggatcatgctcctcaagcccttagcgtagtgcctagcatgtggtgagcattcaatcagcagtagctgctgttgttattcactgtggggttatccttacacccccagcctgaagggtactgcatggaacactgtggctccctatggctacaagaagctgcctccgtgcttcctctgggtcccttgactccctaagggtcagccaagccactcccagccctggaaagcagagggcctttgcttcgcctgcaaggcccaaagctgcttatagttaatgattttacaaaacaggaggagactcaaactggaacaggattccaaggagccagggggaagcataaaaggggcctgcgtggagcgtggactcaagaaatgtgccaaataccaaccaacggccacaggggaggggaggggacaggggagaagggagcttgagacagctgagctagacaagaagggagtactatgtaaggagtcagtttctgttgggtggggctgcaccaagctttccataactagaaagatgccaagagcagtccaagaagggcacggttagtgccaggaggcccagcccagcatcacaggctgcactaagcaggcagctcttctgttgggctggaccaccttttagactaggtccataataagggcacattttcacactgaaaggggtggggtgtgagggtggtggagcctctcagcagccaactttgtcagaaccggctcccagatagccccttcacacagctttagatctcactcccatcggtgtcactagatcctgtgagggcaagcgacagggctagtgccggtgaatgccatgtggcaagttcattaccctcacacatctcaccccacaccctcccagtggagaactcttaacagacaaccatatgccatcattcagtgagagttggtgtattctctgccccagggggtcccctgaagacacctgaggctgggtgcagtggctcgcacctgcaatcgcagcacttggggaggccgaagtgggcggatctcttgagcccaggagtttgagaccagactgagcaacaatggcaaaaccccatctcaacaacaagaaaaatacaaaaatgagccgggcatggtgtcgtgagcctgtggtctcagctactcagcaggctgaggtgggaggatcacctgagcccaggaggtcgaggctgcagtgagccatgatctcgccattgcactccagcctgggtaacagagcaagacactgtctcggccgggcgcggtggctcatgcctgtaatctcagcactttgggaggcc[134 bp omitted]gaggcaggagaatggcgtgaacctgggaggctgagcttgcagtgagccgagatcgcgccactgcacccagcctgggcgacagagcgagactccgtctcaaaaaaaaaaaaataaataaagacagctgagcctcatgagtggttcacatcactcaaggctttgttctacgttcacccctttctgcttctccttctcatttccccttctctttattaaagcaaacaaagtaagatgcaagattcccactgctagttcttggtccgcaacgctgcaggggagtcagggacatgagaactgatatgctttctttacggagcctccgatgtagcaggcatcggaaattgaggtggactcagagttgaggtttcctgagccatttgttatcacccctggctgcctcttccggcctccaacaaattcagcaccatgaagcttcaagtgctccaaagtcaaaaggagaggaaatgaattttcaaactgaagacagtgctgtaaagagccctaaacggcagaagaaaaaattttcttttctttcctttttttttgataaggagtctctccctgtctcccaggctagagtgcagtggcgcgatctcagctcactgcaacttccgcctcccaggttcaagcgattctcctgcctcagcctcccgagtagctgggtgcccaccaccgcacccggctaattttttgtatattttagtagagatggggttttgccatgttggccaggctggtcttgaactactgacctcaggtgatccacccaccttggcctcccaaagtgctgggattacaggcatgagccaccatgcctggcccaaaagaaataattttttaagccctaagaagcagaagtatggacttcatttcctaagcaatgggatttgggggattttgagtgatttgagcagggagggccatgatacagggagtgtttttaaaagatcactccagctgcagggtgtttgcttgattggatggacagagagactaggagcaggaagacataggaggagatgactccaataatgttgagccagcagagtgacatccaggcactgtgacaataaatgctggttggtgtgaactgacctgacttgggactcaaagagaag[136 bp omitted]tggtgaaaccccatctctactaaaaatacaaaaattagccgggcgtggtggcgggagcctgtaatcccagccactcaggaggctgagaggcaggagaatcacttgaacccaggaggcggagtttgcagtgagccgagattgcgccactgcactccagccagcctgggggacagagagagactccgtctcaaaaataaatacattaattaattaaaaaagaagggatgagcctcaaggagtgattgggcagagagaacaatcgcaagggtctaagcccgggagcttggattgacagcaccatggagacacataggaaagccaggaaaagatgcctgtttaatggggacgatgaggagactgattttaaattagctgttactaaaaaaattacatttatcagattttttattttgtggaagtaatcaatgttcactgtagaaattttagaacatacagataataataaagaagaaaatcaaaatcaaccataatatcactctccagagataaacactcttaattttatttatttatttatttatttatttatttatttatttatttattagagatggagtttctctcttgttgtccaggctggagtgcagtggcacaatctcggcccatgggttcaagcgattctcctgcctc[212 bp omitted]ttgtatctgttacccagtgtccaatacacctaaattaactgaggagtttgggaaagaagggacatagaacctggtcaatgtgtttttcttgctaactgggatttaagcagcaaactttttgtctc[219 bp omitted]gagttaggagaatcacctgaacccgggaggcagaggttgcattgagccgagatcacgccactgcactccaggctgggcgacagagtaagactctgtctcaaaaaaaaaaaaaaaatgtatttgtatagttcctactttaggaaatcctgtctggcaaacactatgcacccttgctttgatgaatcttataagatgtcaaggtcatcattatgagtatcagtccgcattgttcagagttaaatacgcaaaggtaggaaggacagaaggacacaacattgaactgaatgtacactgaccccagcacagcccctggaagtttctcccctcctctctcactaaatctctgatatcttatctctttcctctttctccttaaggtggcctgattaattgagggcctgattactttgattgcagttaattgaatgttccttgactacaatgtgcacgagaggagatggaaccggcaacttggcccagcatgtctgacagtaaatctcaagttttcatctttagtagcaggtggtgccatattaccatactgaaggcctgaactgagatgctggaatggccaaagtcaccattttaaattgcacttctctcataaccctgcaacctcctctcagaatctgtacaaagatctattacaaggaaatttattacagcacagtttataatgctgaaaaaaaaaacccaacctaaatgtccaacaataggaaaatatttaaccaaattatggtacacgcatattctggaatattctacatccattaagaagcatgtgggtagttctgtatgtactgatgtgagtatctccaagacatattataaaacagaaaacagaagttatagggcgactgtaataaaatagaagaaaatggaagttattacatgactgtaatcccagcattttgggaggtcgaggcaggtggctcgcttgagcccaggagtttgagaccaacctgggcaacacagcagaatcccgtctctacaaaaaatacaaaaattagccaagtgtgttagcacacacctgtagtcccagctacccaggaggctgatgtgggaggattgcttgagcccggtaggtcgaggatgtagtgggccaagattgtgccactgcactccagcctgggcaacagtgagaccctgtctcaaaaaaaagaaagaaaaaaaaaagaaaatagaagttgtaaactataagcacaatatgagcccatatatgccccagaagccctgtagatgtgtatttgcacgtaaatgtatgtggatgcatagaaagaagactgaaaatacagccaccaaacccacaatcgtagctacctcaggggagggggatggaaataggggctcagtcaagggagtagtcggtatgcttccctattgtttgactcttttatagcacgaatgtattcgcatgttacccatgtaattttaaaacatttttaatataagaaagaagagttctcactcagctttgcagcaggggtaattaggatgcagagagtctgagaggagctaaaaggaaggcaaaatgaaagagtgctcctgagaactgggagagcgccccactcccctccccaattacatttcctgttttctcctcatctgcagtcacctgtggtttttaaatacgttataccacatttcatatcacaggcagaaacactgctctctttctcttctgcctcctctcctgaggacacaccaatttcgttttttaattgaatattcgtaaggttcatattatcaagaacaagttatggtggttccagctgcgcatctttctctcattgctgttactgaaaataaagagtcccttaagcacccgagtaggccacctctgtcccccactccccttggcccctcttccaacctctgtgatagtaagcaagccgtatttgaggcctctgggaactgagggtgcatctgtgtcaatggagaatttcccgcctctgtttcaaaccagggtggctaaattagtagctgtcattctaaagaataaaagcaaaaagtttgaaactcattgctgatgactaggctgtccctaaactttctcctctggccattcccatccaaatactaggaaagcggccaggtacggtggctcatgcctgtaatcccagcactttgggaggccaaggcgggcagattacttggggccaggaattcgaaaccagcctggccaacactgggaaaacccgtctctactgaaaatacaaaaattagccaggcttggtggctcatgcctgtagtcccagccagttgggaggctgaggcaggagaatcgcttgaacgcaggaggcggaggttgcaatgagctgagatcgcacaactgcactccagtctgggcaacagagggagactctgtctcaaaacaaacaaacaaacaacaacaacaaaaatgctaggaaagaaaagaaacactgaaaccggactctcttcagtcacctactggtgggcccaagctctcacacctcccttttctccatttccactctcagccctgaacactgatgtctgaaagaccgtgcaaatctccaagactatgaatcatcggttcagtgatacatgatggaatattaagcagctgagaaaaatgttttctaagaatatttaatgacaaaaggaaatgctcaccaaaggcaaacaacaacaggaaaaccaacctgtatacacagggtcatcccaatgatgggggaaaatacacattttttaaaagattagaagaacacatgccaaaataatgtcagtgatttcttttgggtagagaggttgtaggtgatgttgcttttctgggttttccaaatgttctacaataggcatattttacttttataaacagggaaaatgttacttttttaaaaaagattctatgatgatactttcctgggtaggaaagtggcctcaggtattttagaaaaatattgaactacaaccaaaaaggtgcctgacaatttgggtcatcagagcatttagctttcaggcagttttattgtatataaaacatttattttaccagaaatacaataaaaccctattagtctccttattataacttctttttttttttttttttgagacagtgtctcactctgtcaaccaggctggagtgcagtggcgcgatctcagctcactgcaacctctccctcctggtttcaagcgattctcctgcctcagcttcctgagtagctgggattacaggtgtgtaccaccacacccagctaatttttgtatttttagtttagtagagatggggtttcaccatgttggccaggctggtctagaactcctgacttcaggtgatccactcgcctcggcctcccaaagttctgggaatataggcgtgagccactgtgcccagcccccttattataacttattattacatattatatatataacttattgtcatacagtataatttcttattataatgattcatgtgaaccagaagtcaaatcatatatcctgaaacatgtagcaaaaagtcttgatgaaacaatcaggtagctgatagcttcctctgctgcctccaatgctgccaaggatgccgctgtattatgtcataagaaccacaaaagcactgataagttcccagaggttttttttttttttttttttttctgagatggagtctcactctgtctctctcaggctggagtgcggtggcacgatctcagctcattgcaacctccgtctccagggttcaagtgattctcctacctcagcctcccgagtagctgggattacaggcgcccaccaccacatccagctaatgtttgtatttttagaagagacggggttttgccatattggccaggctggtctcgaactcctaacctcaggtgatccgcccgcctcagtctcctaaagtgctgggattacaggtgtgagcccccgcacacagccaagttcccacaggttttaaaaacaattctcaaatgcatccaacacatcaaatatcagaatgtccctcatgctaattaagccaggctaagaggaaactgagtagtagcaatgccctatcctgggaaagagaaatgtgggggctgttctaaggagaaataaggcctgcaaaagctggcagcacccccaaggggcctcagaaatgcccttcagttggggagcagttgtgctgaagaagcacaagacagactatccttaccagacagaggaggaggcccatttttggcaaatccaatagatgaaactgattttaatacacaagataaattccagagtggcttttcattctataaaaggattcacagcaggattccattaagtagccggctcttctactgcattgaaagcaggattcaatagacaaacattcagctgtcatgtacctttataggaagacaatagctatctacacctacatggacaggcaatatctgaagggttgtttctgttccacttaccgagagcctgctgagctaaaagcatagatcgaccttccctacgactctctccccacccagctcaaggggtcaaagcagggaaggggtggggttcaattctgccacctcattcggaagcagacgcaggcaaggacctaaaagaaatgaggctggagaaaaaggaaacataagcaccatacaatgttagagctggaaacgcccttaaagatcacctaatccagccctttcgtttcacaaaaggggaaacagagactcacagagaggaagtgacttggctcacgtcacagactgatttagtgacagagaatagtgctaggatccaggcccctgtcgagccaacggccactctcaaatggaaaagctgactcaagtggcacatgtgtttctttagactggtaaaattccgggacattgagcttctggcttgatgctggtcaggggcagaagggtcaaggaaccgaatctggaaacccgtgagctccccaaggtggttctggcccacagaaggcaactgaagcagtcaatgcggtggaaggcactcattgtgtgttcctgctctctactcacttccccactttttcctcctgtttccctctcttttgactgcggcctaagtctcagcctggccagctgcccagttctgctgaagaaccccaagactaacacaagcctaagtctaggtcaaatatccccacctcaggccaggggtgacccttgctcagggtgagtgaaactttcccacaaaagccagccagattccctggaagccagacaattgaaagagagttttctaggtgttctggctattgttacctccaatctgctaaaaaagaaaaggtttacccacaggcctctgggtgaatgcccaactgccctctggggagcctgaatttgcctctgcctccatctggtcttgtttaatggggatctgaaaaaaacccagttcctgcctcagcgccagtgttcagagctgggggcctccaatgtgaaaggaaaccgaacacgacctcacacctcatcagggccaggaaaacagagttctgccccgttaccccagggccttcattccgggtcagagagggccatggcaggggaaacctgagccctgaggcctctcgctgagaaggcctgcagatcttttccctggtcacctttaagtgagtggaagggccggctgagagcgcgctgcataattcagcagatggctgcctctaatgagaagacactgaagaagaggataacattatttctcaccctcctgagcatgtggcctccttcctctgtgcaggcggcagagaaacccacggtttcaaatcccagcagcagaagcctcctcctgccaaactgaggaggaagggtctgtgtttctaatttattctgcgccccccactccagttgttacttaaaataatccatcattacatggctggtggctccaagatttttatttaaagcaatatggagaagaaaaaataaaaaagaaaacccacacaacccgtgactgtgctatattggatttaagctgagaatctttttaatatcagagagtctccgaatcaccctagtatactcttccctgggccctatgggagtgctgagggagtgtagtgaaaagagggggaagagaggtcatggcaggattttgatgtcttagaaacatcatgaaaagacaagtgtttttaaacaaggaatctgtgtcatctggtgggtgtttaatcgtatcacccactgaccagcaatagcacttcggactaagtaacttggtctccctacacccattaaataaagggaacagtaatacttgtccaggaagccattggggaaaatgaaatcatacagatggaagcatttcgagatcgttgaaagaaacatgttatatatatccatggctttccttctttccttctttttccttctttccttctttctttctttcatctgtctttttttttttttcttttttgagacggagtctcactctgtcgcccaggatggagtgcagtggcacaatctcggctcactgcaagctccgcctcccgggttcacgccattctcctgtttcagcctccagagtagctgggactacaggcacccgccaccacgcccggctaattttttaatttttagtagagatggg[134 bp omitted]acatgcaactaaaagcccttctcaattgttcatgctaatattaaaccatggctctgatcatccaaaaacccaggcaagtccagaaatcagccctacttagtttgggaatacctttttccagaggacttatcttcctaattggctttgctcaggctaatgcaataggtttgctcccttatagcacacaaaggcagtggccatgcttggtaacaaagccagcaattaatagaaaatttacagcagagactccacaaagtaaatgctatgcacatgactgcagatcaaaatctcattagatgatacagacaaatcactctgctataatgtagttttgtattaagaacaccgctaacactcacatttccaggatttaggatgtaaaaaggaaacagggcttattcctgcctttcatctggaagctgtgagagggcagagttcctgcgtgccttggccaccactatatcctcagcacctggcacggggcctggccgatcagtgcccagtgaatatgtgctgaaggaatgaatgaaaataaaagtgggtgaattggcaaatgaaatgttcccaacccagtagcagatgtgagatctcacccaccttcacacctacccatttcctatttgaagccctcaggaagcccttcctgtcaccctctgcctccattcattgctgagttaggttcccttagtaatgaaatctcatggcaggcagtcactctcctgtgtagcacttatcacaaagataattagatagtgatttgtgtctgcctccaccagttccttgaaagaagggaccatgtgcatttgggggacattgtcattctgcccgctttttattttgaaaaatcccaggccgggcgctgtggctcacacctgtaatcccaggactttgagaggccaaggtgggcagatcacgaggtcaggagttcgagaccagcctggccaacatggtgaaaccctgtttctactaaaaatacaaaaattagctgggcacggtggtgcacacctgtaatcccagctactcgggaggctgaggcaggataatttcttgaacccaggaggcggaggttgcagtgagctgagatcgcgccactgcattccagcctgggcgacagaacaagactccatctcggggaaaaaaaaaaaaaaaaggaaaagaagaaaagaaacatcccaaacacacagagaagttagaaaataatgtaatgactgtccaaaaacccctcaaatttagaatcaacatttttaaatatttagggccatgtaaactttcttccgtgttgtatcaccaatagagctaggtaatagggttttgttttctatgtttgaggtacgatactacctttagtgggtggtggtaggaacgcctgaagcagagacctcaaagggaatcaaagggtaactgccacgtgatgatagcaaaaccagagtgcagcagcaatcttttccccacctgaagacagttgctctgagacagttgacccagaccaaccccagctaactttgtagggcaaagttagcccctgaaagttcacttgggagaatgaccactacctagattgccactagagaaagcttcattgttcacattgtgggactagttcaagccagaatcatccagatgctcttggtatgggccggcatttacggtctggatcccagaatgcaacattgaaaggaacagctcattaaaagagccagcacatgcagcttttggggcttgccctgtgccttggttaccttggacaagtcatggaacctctcgaaatatatattaatagcagcccaagccacctcatagtcagggggtgaggtggggcatcacaaggatcttctatagttctttaattatttcacagtgtccacaatttgtcattccaactagactataagcttaaaagccacgaacttttttttgttttgttttttgagacggattcccactctgtcgcccaggctggagtgtagtggcacgatctcggct[135 bp omitted]ctcgatctcctgactttgtgatccacccacctcggcctcttttttttcttttttgagatggagtctcgctctgttgcccaggctggagtgcagtggtgcaatcttggctcactgcaacctctgcctccagggttcaagcgattcttctgcctcagcctcctgagtagctgtgattacaggcacgcaccaccacgcctggctaatttttgtatttttagtagatacggggtttcaccatgttggccaggctggtctcgaactcctgacctcatgatctgcccacctcagcctcccaaagtgctgggattacaggcatgagccaccaagcccagtccgatcacgaacgttttttaaagcctgctacctttttttgtccagttgacaagggctaaccatagtgctggccacatatcagtcaatcaagtaaatatggacacagtggagaaatggtgttgtcacaccaaaccgtttgtggtgttcattcaaatgggacggacttgtattatgtgcaccagaattgaacttccaagttggctgcgtgcaatgtaagccctacccaacaacttgaaggcttgttttagtcactaaggatgtttacccacagtgactctcaactgattctagaaagaacacaccccccacatacatacacatacacacacacacacacacacacacacacacacacacacactagggcacttactcgcatggtaccacgtctcagagctcattaaaaagaattcctggccgggagcagtggctcatgcctgtaatcccaacactttgggaggctgaggcgggtggatcacaaggtcaggagttcgagaccagcctggccaacatggtgaaaacccccctctactaaaaatatcaaaactagccaggtgtggtggcgggtgcctgtaatcccagctactcgggaggctgaggcaggagaatcgcttgaacctgggaggctgaggttgcagtgagccgagatcatgccacttgcactccagcctgggcaacagagcaagactccgtctcaaaaaaaaaaaaaaaaaaaaaaaagaattcctaagctagccacacttaggtttattctctagtcttctgttcccaaaccctgaatacatgttccttggaggaaacaagcagcaaccagatgtccaaggtctcctgagttaactccgtcttccctggtgaattacaacttattgcagacacaaaggagaacagagagacaaatgacacataaacaggagcttcactggctgggggaggggggcatggagagtgacgtcagttttcccagaaacccatttatcacgataacaaggtctcgagtgcttaggctgctctttcagcttcagaatctggcgtacaattatgttcttcatcatacagtatggcaaggccagccagagcaaactggagccatgcaaagcaaaccaagtggccctaaagcaccccctcacccccatctgcagaacaaagggcatctctaggttgcctgagttgtgcctgaggtgaaacacacacaaccttctggaatgttccccattgcaacatctgccctgcaatcctaatccaggcaagagaaactggtgagagtatggaggacaggtcgatgcaaattcattagctgacatgaaaaatcattagcgtcatttttggatggagctagtgtaatcccagagattaattcctctacttcagctataccatctctgaaatgcaggtaaccaggagcagaaaagccacagcagaaaagagggagccctcaaaacactaaagcaataaacaacgagagtgccaatcttgggggaagaaaattctctcaaattgcatcatcacagagaatgtcccctgtctactcctggtccttccacaacatgactgcataaagtgctctgtgctagggtgtgcagggggtggaggaggttccgaagaaatgatcctgcccttccaaacagggacaaaagagacattaatacatattctgtagagaaaatattatcagattctggcttcagattttgtaaaatcaatttcaattacaccaaatacctagaggctttttttttgtactgtagttgcattgcatgaactattttcctaaataagtaagctacaaggttgaaaaacatttttatgtggttcagagattttcgtcaagtagtatgtggtgtcatgggatttgacctacctctgtctcccactccttcctcacctcggggtgctggtgggcttattaaagtcccagatacccatggatgaatagaatagctagggtgtcccccccaaatggaattcatcgccctttgcaaccaaacttctggtttaaaaaacaaacatggagcctcaggtcacttcaacatggtttctctgcacatcccaggctggaaaacttcagttctttaaatgaagattttttttttcccagagtcggtcgccaacaaaaaaagagacggcaccgcttttgcgagtctcacacttattttcctgagtctccatagaaagaagccagctccacaggttttggcacacaagcccagttacactgaacatgcacccgagacagatcctcagaggcccgctccaaaacatgccaaaatacgcagccagccacctacaggccagccaactgcaccccacactgacgcacaaatgagacccagaggcacacagcacaagcagacagagaggcgttcggacacacaccacagaggtgagcacactcagagaaacacgcggacttctttgggtcacagacagaaccccggcgccgccgccgcccgcccgggaagacacgagcgcgcgcgcgtgcacacatacgcgcacaccgatacacacacagacgcagtcacatatgtaatgcatatagagaaaccctatcccagccagtcacctccccgcccccctcgccactcaccgccttctgccccaggctaaccccagccccgcgcctctttgcctgtgcggtcccgggtcacaacgggcagccgtgcgcaggggcgcggcaaggccagggtgccagggacccggagggctcggcggctcctacggccattcattcggcaacgccccagccgtggggccgcagctgcagcgagggaggcggtggcgctcactgcggctcttgggcaatgcaagttcagccgccggcccgcaggttttgcctgcccccctgccgccccccgccccccgcgcgccaccaccgttttccgggacaggctgagggactgagctgctgaccccgggagcagaagtcccaccgtgcccttggctcctggatgctgcccactgccctcctcgcgatgtggcggcggcggccaggtctccttgaccctcaccaggccctcggccccggccctggcacccaagctctgcacttaccacctggcgagctatatcggtcgctgccatcgctcctgcgtccgccagggctgccacgggtgccgccgcaacgggagctactgcacaggaaacagaggagctcctccgacaaagagaaagtgttacacttcgggcgcgaccaagtccggtggggggaggtgcaagggaggggccccctcgccgctgctccaaccccaacctcccctctaccgcccaccccttgaaagtagggtatggagagggggcggatttaacgcgccgcttccccctatggccagaccagttccagttcttcctgcaaccccagccataggcttctacgaaggggggcgggggctcccctcggtgaccacgtcctctgccccccccgccacttggctccgtggtacgtcccgacctctgctgaattgtcacacccccctgctctcctttacatccctaagtccccagaccccgaaggctggaagggagcccccgcccctcccccctcccatactctgctcagcggccgagctctgcagttctcctcccggcccccgttaccccccttcctttccaccgagatcccaaggtgcttagatgggtgcgccttggccgctggagtctcgatgccccactgtcgtgtctccctccctccatggcccgggagcgcagctgcggccgaggtaccggggaggcctgcggcacctgccgctccacagtagagcttagaaagggggcccgtggggggagccgcactgcagcccggcaactgagctgagctgtggcatgtggggtccgaggctagaggtcttgagacgctgcttctgccctggggtttccaagccttgggtgctgtgggctgtaatttcgtggagccaagctcaccacctttgggtacctagtacagacggaacccacgcctcctctctccgacccagccctagacgctcagcaagaccacccaccccttctagtaccagaggaagggctggagatgaaggttctcagctctatggagcgaaatggaggggcgggtgacggggagcggcctccagtcactctgtcccgccccctgatttctccttgaccctcattcagcccgggacaaggcggccaatagggcgcagaggagagaacttccgaaggcaggggtgcgcccgcccgccctccttatccccgtggcccacctccgcgggtcctctctcgtgggcacctctccacttctccggccttggcgccctcccctctctcttgggactggcctcttgctagctccctgtcactggagcacgctggcagatttggcatgcccgaggccccagcgggagggacagtacattccactcctcaaaagggcaggttccctggtgtgggagagagacctgggcccgccagagggaccccagatgggggaggggatgacaaggctatggaggaaacccgggcccaagagggggccccaatggagcatggaagatgaccccgtaaaggcccaaggctggagcagctgaggaggaggcaggagagagggaaaaagaaaagaaggaaccagggagagagaggaagaagggactcgatccagaggccctggtctcggagaagtcagggaagacaagaaaatggagtagccaaagaagagcatgcctggcacttggttccacctgctggatggagcttctcacactctctcgggaagccctttatgtatgtaccctgtgcgcctggagaacaaggactcagcaaacgcatcccagggccgagtgcagggcctcgcagtcaggaggcactctattaagctgagggcagagaacttggatgcgtgcgaggggggcggggagaagaaagaagagacacagtgagggaatagcagtaaggacagtcatgaagagccaagtattcagggagcgccactgtgcgccttcattgtgctggagacccaggagcggcctaaagagaagagcctggcaaaatcagggatcagcgcagaggagctccgcgagacagaaggcgcaggccatagggcggatggcggtggcaaggaagaggggcagctggagtctttcagactctctggagctttggggcagggcctgagccctggactgggttggcagtgacacgggggaccagtgctatatctgaggaaccacggtgaggcttgggccccaaccgcatgggggcggggagtcagaggtgactggcggcttccaggctgggtgtctgggacagggctcttccctggcaaaggctagggcgtggtggactgaaaggccccgaggtcactagccccgatctggacttggggtttgggtggtggtgggacaaaaggggagaatttggaagccagagcagaaagctgctgccggaacgggaggggactggagggctgcgggtctcccgggagaatcccccacgcactgccccgcccgccttagcactcctcgcggactgaagctccgtacttaccggcccagcgctgggggcacctgagcacggaatccttggtgtctcatccatatgccccattcggccctcctgtccctagagactaccagaacctcactgcgtcctcctcctccaaaacgctgaacctcgaagacctgaactaagtgcttaattcaagtctcctgggaccctttggttcctccaatacctgcccacctgcggctacaagtccctcctggggcctgggcctccagcctccttcggtggggtgtgggtcagtgtgtgtgttggtcttgatgtgtgagtagatgtgtcggtgtgttcgtgtgtattgtcagtgtgtgctagctgtgtgtctgtatatctgtgtgtcaatgtgtgtgttggcatgtgttggtgtgtcagtgtatttcaatgcatggtgagtgtatgtgtgtcaatatggagagaggtgttagctcactagctttacataccttatctcactcagtgcagtgggccgacgactgagacgtgtgaatcagaacattcatttcaataaagaggtttggaaactctctgggatcatgcctttctttttttttccttttttattttttttttgagacggagtgctctgtcatccaggctgcagtgcagtggcgtgatctctactcactgcaacctctgcctcttgggttcaagcaattctctgctgcagctgggactataagcgcccaccaccacgcccagctattttttttttttttttttttttgtatttgcagtagagacagggtttcaccatcttggctaggctggtcttgaactcctgacctcgtgatccacctgcctcggccttgcaaagtgctgggattataggtgtgagccaccgcacccggcctgaaatcatgcctttcagtctttgtcccgggtcaccttcccaagaacaggggagatggaagggctgaggaggcaagagggctcatgagtggtcagttcgtgagttttcttccttgaatgtctgtcctcgttgatgagtgaagccaaaagattcccctttatgaagagtcatttgggactcccgggcgcttccatgaacatgtatgtgctcatgtttgatgtttccttgtggggtcccttgggcccagcatggtgtctggcaggtgttcaatcaatgtttgttgagtaaaggaatgaacagaagcatgtaaatgaggtggcttcagtatttccatgtccttaaagaagctgcaacaaacagagacttcccaggggcaagcaggtggctgtcattagcatgccaatgtttgtggagccagactctactgcctgggagcagaaatggctacccctgctagataagagtgggccctaattggagcccagctttccacaggtcactgctggagttgggggtgctaatactggatagaggagcagcaagcaactcaggggcagggagggagaagagggcactgaaatggagctaagaggtcaggaaagggctttgtcctgaaactgtggctttgtgataggagaacgagaaagatggtagagtcagtctcaagtggagaagccctgagaaccatctgaaaaataagatcagaaagttggaggaggggccgggcgtggcggctcatgcctgtaatcccaacattttgggaggctgaggcaggtggatcacttgaggtcaggagttcgagaccagcctagccaacatggtgaaacccccgtctctactaaaaatacaaaaattagccgggtgtggtggcgcatgcctgtagtcccacctacttgaggcaggagaattgcttgaacctgggaggtgaaggttgcagtgagccgagattgtgccactgtactccagcctgggtgacagtgcgagactccatcaaaaaaaagaaagggagggggagagagagagagaaaagaaaagaaaagaaaagaaagagaagaaagttggaggaggaagacaaggtgaagcagggaaaatgatccgggattcaccaaatccagacagtgccaattaaatcagaaactctgtgaaggggctgagtcaaaatgaactaaagatccctttcctcaattctgcattatcacctgctgcccctggttttgctttagtttctttccagtgtttcttaaaatgtggcctttgaagcatcagcagcatatgggaagttataaaaaatgcaaattattgggccccacccgagacctactgaatcagaacttctaggatgggacccaggaatctgtattttaacaagtgctccagtggattctgatttatgctgaagtttgaagaccactggtttatcttgaaaatctagccctgatgggttgggatacaggactggtaaggtttggtaggatattgaaggagaagtttgaaggccgggccattgccaataattgtagatctgttggatttctatggtgggaggagtgagggtatgggaaagggggtgccaaaaaagtaatagaagggaacccagcaggagctagctcactagaagagttagaaagataaactttgcctcccgatatggttaggctttgtgtccccacccaaatctcatcttgaattgtaatccccataatccctttgtgtcaagggagagaccaggtggaggtagggaaagaccaggtggagataattgaatcacgaggtggtttcccccatgctgttatcatgatagtgagtgagttctcacgagatctgatgggtttgttttttttttgagatggagcctcaacctgtcacccagggtggattgcagtggcacaatcttggctcactgcaacctccgcctccagggttcaagcgattctcatgcttcagcctcccgagtagctgggattacagacgagcgtcaccacgcccagctaatttttgtatttttagtagaaagagtgtttcaccatgttgaccagcctggtctcgaactcctgacctcaagtgatccgcctacctcagcttcccaaagtgctgggattataggtgtaagccactgtgcttagccagacctcatggttttataagggactcttcccccttcgcctggcccttctccttcctgatgccttgtaaagaaggtgccttgcttcccattcacttttggccatgattgtaagtttcctgaggcttccccggccatgctgaactgcattaaacctctttaaattacccagtctcaggcagttctttatagcagtatgaaaatgactaatacaccttctttgcaattttcattcattccacaaatactcactaaatctcaactgccaattgctaagtgccagaggactcaagaaagaataggtgacaagaactcctaccttcaccttaagacactcccaggacagttgccagatagctctacaaacaaccagtaatgtgataagtgatataattggtcaggagcaacaccctggggaggaagacacccagagaggtgagggaaggtatctcaaagaagagccatttggattgaatctttaagaatgagtggtggtttatctggcagtcaagagggggcagcagagagaatagcatgagtaaaaccagaaagaaagggcagagagcatttcaggaattttaactcttggccagagggagtggtaggaagaggggacagtggctataaatgagactggaagataagatggggctggatctggaaggatcaggttggtcataccaagttgcttacactttttgctccagaataggggttctcaagctctgctctccagacaacgcctggaactacgcccaatgtaaatgggatgctcacagtgcaaaaaaaaaaaaaaaaaaaaaaatcagttaatgggtagaaatttctctatttgaactttttttaaccataaattttcctaaatctttgacagatgctcctgcttatctgctagcaagtaacaaaaatgaatgaacaacttgccaacgaatataaaacagacaaacgcagtactaatcatgcttaattcaacagtttattttttcacggacatctgtacttgtggctatgattttatattgcacacacataatgtggacatatttttagctagcagaagtgttcttttgaaaagtgttttatttcatatggcatgatttaatatatgaattatttcattacattctggaaagagcaccaccacatccagatgctatgccacctgaaccagttggagaaactatcccttaaatagtgaggagtcactgaagagttttgagcaggagagtgacttgaacatatttgcaatttttttttttcttgagatggagtcttgctctctcacccaggctgcagtgcagttgcacgatctctactcattgcaacttctgcctcctgggttcaagcaattctcctgcctcagcctcccgagtagctgggactacaggcttgtgccatcaggtccagctaatttttgtatttttagtagagatggggtttcaccaagttggtcaggctggtctcgaacttctgacctcaggtgatccacccgccttggcctcccaaagtgttgggattacaggtgtgagccaccatgcctagcccatatttgcaattttgaaaggtcactctctctccagcttgggaaaaagattggaacagaaggcgattaaagcagttaggggccaggtgcagtggctcatgcctataatcccagcactttgggaggctgaggcaggcggatcacttgagctcagacgttcaaggctgcagtgagctatgattgcaccactgcactgcctgggtaacagagtgagacctcaactctaaaaaagaaaaatatgcaagacttgggagtgaggacactgctgtagcagttcaagcaagaaatgctggtgacagcgacatgagagtggagtggcatggaaggaatagactcagcattacaaggggccacccattaaaggtcttgtgtgccattctatggatgctgaagtttcaatgtgtagggaataaaagagcctttgaattcctgtttcttaatgggtggtacccaaccagctgcatcagaatcacctatagtgttcctaacagatgcagggccctagagcccacctcagatctgctgaatcagaatctctgtatgagagaaagaatgtggatttgtaccaagcactccaggcggctctgaggcacatcaaagttggagaactactgcgtgaatggttattgagcagtggcatgacagagtgagatctatgtttatgcagatcacttgagtcaccacatgaagaactgattgaatgaaggtaagactagaggcaggaagccgggcgcggtggctcacacctgtaatcccagcactttgggaggccaaggcaggtggatcacgaggtcaagagatcgagaccatcctggccaacacagtgaaaccccgtctctattaaaaatacaaaaaaattagccaggcatggtggcacgcgctggtaatcccagctacttgggaggctgaggcaagagactcgcttgaacctgggagttggaggttgcagtgagccaaaaaaaaaaaaaaaagactagagggagactagttagcagggtactgtaatagtcctcagctaggcaagacctggaactcaagagaaggctgggcttcccacccacatcatgacatactagttatccttataccctggtttatacacactgatttagacaaacgatataattttgtattcccccaaacaactgttgtttgctcagcagtattcccagagccatagagtacgatcttgtagaaagtattgagcacctgccatatctaggaccctccacta[131 bp omitted]catggtaaaaccccgtctctactaaaaatacaaaaatttcctgggcgtggtggtgcatgcctataatctcagctactcgggaggctgaggcaggagaatcacttgaacctggcagggacagaggttgcagtgagccgagatgttgccactgcattccagcctgggagacagagcgagactccatctcaaaaaaaaaaaaaagaaaagaaatataaagtctagtttctcatgcaacactcccatgtaacaaacctacacgtgtacccccgaacctaaaaaaggaatggtggggtatatccagaaaaaatatagttttgttctgaaagagcttggtgtctaactggggagactacacacacacacacacacacacacacatacacacaaagtcaaatagcaaataccaaatacgtcataaggcagtatccaaggtgtagtacagacaataaataccaatgttctacttcccggtggtctttacatgggtgtttgctttatcaatattgattctgctgtattttatgctttaggaactcttctggatgtatgttatatttcacaagaaaaaaaagtttacaaagacaccgagttctgcaagttgagtgatactgatcaacaacccatagatatggtagagaattgagagaaacaaggtctgtacccagtggcctcacagttctccacagacaagtcacaaagactgtgagaggattgaaataagacacagaaaaataagagacagatagaaaaagatggtaatgagccaggcgtggtggctcacgcctgtaatcccagcactttaggaggc[135 bp omitted]gaggcaggagaatcgcttgaacccgggaggcagaggttgcagtgagccgagatcacaccattgcactccagcctgggcaacagagcaagagtctgtcagaaaaaaaaaaaaaaaaggccaggcacagtggctcatgcctgtaattccagcactttgtgaggccaaggcgggcggatcactaggtcaagagatcaagaccattctggccaacatggtgaaaccgtgtctctactaaaagtacaaaaattagctgggcgtggtggcgctcgcctgtagtcccagctactcgggaggctgaggcaggagaattgcttgaacctgggaggtggaggttgcagtgagtcgagatcacgtaactgcactccagcctggtgacagagcaagactccgtctcaaaaaaaaaaaaaaaagaaagaaagaaagaaaaagatgataatgacaccttggtgagatattggcttcaccatcaccaccattactcattgatcaagatgagatatccattttatatcaagctctcaatactttgcatttatgtactgatttctttttgtacccatacactgtgtacacagatacatgtgcacacccatgcacacacacacgcacatctcattccaaaacagattttatgggtacatcaggatcaaaacagagaattcaaatatgctatttctagtgggttgatataattgctatgattcagctttgtattacactggagtctccagagaaacagaatatatgtatattaattttatatacttattatattaacatatatgatatttattataaagaattggcccacatgattatggagtctgagaagcccgacaatttaccatctgcaacctggagaccaggaaagtcaggggcacaaaattccagttcgaatccaaaggcctgagaaccag[135 bp omitted]aacatggtgaaaccccatctctactaaaaatacaaaaattagccgggagtgatggcaggggcctgtaatcccagctacctgggaggctgaggcaggagaatcacttgaacccaggaggcagaggttgtagtgggctgagatcatgccactgcactccagcctgggccacagagtgagattctgtctttaaaaaaacaaaaaagatccaaggacaggagaagagaaatgcctcagatcaacagttagggaaagaaaggcaactcaatcttccactgcatttttttaagagacgggatcttactctgtccccaaggctggagtgcagtggcacaatcatagctcactgactgcagcctcaaaatcctgggctcataagctcaagaattccttctgccttgggctcccaagtagctggaactgcaggcacttgccaccatgcccagctaattttttttatttttagtagcgacagggtctcactttgttgtgcaggctgatcttgaacccctggtctgaaacaatcctcctgcctcagcctcccaaagcactgggattgcaggcataagtcattgggcccagcttcatctgttttttccttctattcaggccctcaacagattagatgatgcccacattggggaaggccatctgctttactcaatctaccagttcaaatgctaatctcttccagaaacatgttcacagacacatcctatttctgggaatcccttggcccagtcaagttgacatataaaattaaccatcgcaagctttaaatatgatttttagctttctggaaggcatagcaaaaggaaaaatactagcttgcatagttttatgtatttcctatacacaaaggtcactatgtgattcattaatcccacaaatatttattgagtacctaccgtgtgtcaagtcctagactaagtgctggagattaacagtgagcaaaagcagacttggtccctgacttcatggagcttacagtctaatagggaagacagatagcaaacaatatcacacacattaatgaaaaaataaaactgcaataagagcacctaggagatactcatggtgccctgagagcctataatggtggtggggtgggatggggacagatttgacttagtctagcagtctagtatgtccatctatgaggcttcatggaggaagtgacgtttgaattcagatcagaagattaaatgggtgtgagcaaggtaaagggaggatgggagtaggaagagcattccaagcaaaggaaagagcatgtatgaaaactctatgcaagaaacagagggtgggagtggtgacacacacctgtaatcctagcactttgggaggccaaggcaggaggattgcttggggccaggagtttgagaccagcctgagcaacatagtgagacctcatctctaaaaaaaaaaaaaaaaaaaaaggttaaaaaattagccaggcatagtagcacatacctgtagtcccagctacttgggaggctgaagtggaaggattgcttgagtctggaggtggaggctgcagtgagctgtgattgcaccattgcactctggcctgggcgacagagcgaaaccctatctcaaaaaaaaaaaaaaagaaagaaagagagaaagaaacaaaaagaaaagaaagctgatgtggctgaagtgcacagggaccagagcaggatgaaatgagactgaagaggtgagcatagagcaagatcacacaggcccctagaccaacattaagggggatatttttatccaacaatataaaaagcaaacaggaagcaacaggaagccactgagagtcttaagacaggagagtgacataatcagatccatgttctgaaaagttcccttgtcttcagtgtggacagtgtattgaaaggcaaaaagagtggaggcaggaaggtcagttaggaggctattgcagtggtccagctgagagatcatgcgggcttgtactagggtgttggaagtggaaatggagaaaagaaaacttctttgggagatatttaggagggaaagacaacccagacttggtgatgggaggtggaggatgaggaagacagagatgccaaggacaactttgaggtttctggcttatgtggtggtacattttgttgagatggggagcactggagaacctctgatttggggaggaaggagaaagtctttggcaccagtttgggacatgttgagtttgagaagcttttgaggcattgaaggggaagatgtcgagtacgcaattacagctcagaggagagataaaagtataggagtcattggtttgcaggtggtatttaaacccatgggaatagatgaaatgacctagaggactcaagactaatccctggaaaacctcaacattaagagatggaaaataggaggaagaacctgaaaaggagaagccagagaggatggaggaaaatgcagaccaccacatgccactgaaacccaaggacaagaggatttcaagaaggtaatggtcaacaaaactgaatcctggctgggcgcattggctcatgcctgtgatcccagcactttgggaggccaaggcaggaggatcacttgagcccaggagtttgaaaccggcctgggcaacatagaaagaccccatctctttaaaaaaaaaaaaaaagagctgaatattgccaactgccaaaaggtcaagggagataagggaaaactgtccatagaatttagggttcatggagctcattgagctaatcaagagctgttttgggagtgtgatggtggcaaaaaaaaaaggctcaagtatgctgaagaatgattgggaaatgagcaaatggattcagcaagtactatatagccaatttgaaaaaacaacatggctgtaaaggaaaacagagatggtatggtagctggagaaggatgtagaggtcagagtttctttaaagatggcaggctgggcgtggtggcttacgcctgtaatcccagcacattgagaggccaaggcaggcagatcacttgaggtcagaagttcgagaccagcctagccaacctggtgaaaccccatctctactaaaaccacaaaaagtagccaggcatggttgtgggcacctgtaattccagctacttgggaggctgaggcaggagaattgcttgaaaccaggaggcagaggttgcagtgatccaagatcacgccatagcactccagcctgagtgacagagtgagactctgtttcaaaaaatagacaataataataataaaagaaagatggcagaaaagacatgagaatgttaaatgttgttggaaaggattccggtgaaaggtagtgattgaatacacagagtactgggctggtaaatgtttagtaattggctttccaagaaaaaaacaaacaacaaccctgctgtgcatcatttgccgatttccatggtgtaaaatactctcactatgactgatttcaggctatctatgtgacgtttcaagccccgcaagcaggctgtagcacactgctgacaggagaaagaagaattgaaattcgtagttatcagccaattgtatcttctcttttataaatttcctgtacatgtccttagctcacttttatattgaaacacttatctttctcttgggaattcacagaggtctttgtgtacatatgaatattaatcctttctcatttacttatggtggatttttgtataagagttttaaaatatttatgcagtcaaatctatcaatacttccctttatgatatttgcccttagtgttcttcattttattgtaaattactaaattgtcactctgctttgatgaatgtgaatttggctagcatgaattatctttcggaagctgaggtgttttaaattgcaaagacgaggaacaaactgtagatcttagtatattcaccaaggtattagcatcctgtgtggtctttcggtggccaggtaacactcctaatttcatcttttttttgggatggaatctctctctgtctcccaggctggagtgcagtagcacgatctcggctcagtgcaacctctgcctcccaggttcaagtgattctcctgcctcagcctcctgatcagctggaattacaggcgagtgccaccatgcccggctaatttttgtatttttagtagagacagggtttcatcatgttggccaggctggtctcgaactcctgacctcgtgatctgactgcctcggcctcccaaagtgctgggattgcaggcttgagccaccgcgcccagccaatttcatctttacaactaagtatttaaaatatcataataggacagaaaacacttgcaaagggcctgctcccttctttttacatttcttttcttttcttttggagacgggctggagtgcagtggctcaatcatggctgactgcagcctcaacctcctgggctcagctggtcctcccacctcagcctcccaagtagcggggaccacaggcatacgccaccatgcctggctacgtttttttgtttattttttgtaaagacagtatctctatgttgcccaggctggtctcgaactcctggcctcaagtgatccacccacctccacc[132 bp omitted]tcactgtagccttgacctcctgggttcaaatgatcctcccacttcagcctctccagtatctgagactacaggctcacgccactatgcccagctagttttttgtgtagacaggggtctccctatgttgcccaggctggtgtctaactcctggcctcaagcaatcctctcaccttggcctcccaaagtgctgggatttcaggtatgagccaccactccccgcccttctttttaaatttctactccagtgatttgaatgtgtgtttcaatcacctggacagatattttccctgccatggcaaatacacattcagggacctttaggaagctggtgacaaggttttatcattacctgccaagagagacctcaaaagataatcagtcatggtattttactcctgttagaaataatcaagataaaattgtaacccctgactttggcacatattttctgtaactcaattggtcaatattaaataactttataaaatagattcagtcacctgagggcatattgacttgcagctaattcaacgaagcagactcatggagaagtcatgttacttaaaatcagacattccacagtgtcagccttcagctgagagaccaagtcaaggatacagtcagggtttaaaggggtgaataaactggtggaatacattcattcattcatttattcaatagagatttatagaacattttgtgtgtgctgagacctgtacatgacattgggaaacagtggtgaacaagtgcattatggaatgtacagtctgggtgggagttgggggatgaaaagtcacataggttattataatacagagtggtgaagaaaagaatggggtcctcaggatgggtacccaattgagactcaggtaattaaggaaggctttacagatgcgttgatacctaagttgatgcctgaatggcagtaggaagtggctgggtaaaataggcaaaggaaattatcaaattatcagaatgaggtctaagaacaaaacactggtaaccagaaatgggttgggaaatgccagatgtcaacaaaagcacaggggtggattccaatagtgtgaatctattatcttgaactggagtcaaaactgagggtgagtagggatgtgtatgtgggggaggaaggggtagttctttctgcggagacatggggcatgggggttttgaagacatctctaaagcaaggcagaaatttcttggcttaagtgtggataagatcttgtcagaaaggataaaacacccctcatctaagctcgcttttttttttttttttttttttgaaacaaaatcttgctttgtcgcccaggctggagtgcaatggtgtgaactcagctcactgcaacctctgtctcccgcgttcaagtgattctcctgtctcagcctcctgagtagctgggattacaggtgcacaccaccatgcctggctaacttttctatttttagtagagacggggtttcaccatg[135 bp omitted]aaaggggtccttcatgtggcctttgcagtgctgcaatagtattgaggtttttctatgaccatggaaagtgactgattaatgctctgctctgtattatggaacatggggactcaatgaagcatttttttgacatgttggcaaagggccaaaactatttcctgagaaagatctgggcttcactgcaagtagcttcatggcccacctccatgagagctcctacgacctcccattcaggcaagaccagaggtcgagcttctcaatttttgtaatagaatatctacaaagcacctctgctattggtttccaaaatatatgcattagccttcaataaacatttttaatttagagctaaaatactagctctctaagcccttgtcagagattacagttttaaataacccaccatggagttctgatcacaaatctagccatgagacctgaaattttagagaagtttgtttaaggcaatgtttctccattgtaggttacataataaaaggtgtagatatgtacgggccacataaatcaataataatggtgaaatatggcttgttgtttatttaacaatatgtattgtggagacagtaatacaaaagcacccccaaaagttgtatcaactgtattcactcaaaagtgcatatttataggcctactgttggtcattggtcaagtctgactgatccaataataagaatagaacattggtatttaacaaaataaactggaacagcgggagctattcagcctgggcctgtctcatgctggctctggagacagactcctgatggaagcttcattctggaagttgtcagaaagagaatgcgctttcagctgcatcacgaagaccctaatctcgtctagagtttggccatctagcctgagcaattgggataaacgtcacctgcaaaacctgggggatggtggctgggcgcggtggctcacgcctgtaatccctgcactttgggaggctgaggcgggcagatcacgaggtcaggagatagagactattctggctgacatggtgaaaccccgtccctactaaaaatgcaaaaaattagctgggcgtggcggcacatgcctgtagtcccagctactcgggaggctgaggcaggagaatcacttgaacctgggaggcagagcttgcagtgagcggagatcgagccactgcactccagcctgggcgacacagcaagagtccatctcaaaaaagaaaaaaaaaacctgggggatggtgtacttcttggttgctccagttcactgagctgaatgttgacacactctagtagtaggtttcataattta[135 bp omitted]tgtgatcccagctactcaggaggctgaggcaggagaatcgcttgaacctgggaggcggaggttgcagtgagcagagattgtaccactgcactccagccttggcaacagagcaagactccctctgaaaacaaacaaacaaacatacaaacgaaggtctgtacttccaagtcaatcataaaaatgtctttaaaattacattcttttgtttatgaaaataaaacattgtttatactcatcaaaacctatgaatgaggtgaatttagtggtatgtggattataactcaataaggtgttatataaaaagaaaaaacccgtctgggtgcggtggctcacgcctgtaatcctagcattttgggaggctgaggagggcatatcacaaggtcaggagttcaacaccagcctggccaacataatgaaaccctgtctctactaaaaatacaaaaattagctgggcgtggtggtacacgcctgtaatcccagctactcgggaggctgaagcaggagaattgcttgaacctggcaggcagaggttgcaatgagctgagaccgcgctattgcactctagccagggcaacagagcaagactccatctcaaaaagaaagagagagagagagagaaagaaaaagaaagaaagaaagaaagaaagaaagaaagaaagaaagaaagaaagaaagaaagaaagaaagaaagaaagaaagaaagagaaagaaagaaagaaagaaaagaaagaaaggaaggaagaaaggaaaaggaaaaaaacctatgagtctcttctgaccatcccatcactgtgccttaaactcacctgggccttctgcactataccaaggctgctacaggaaacgcaaggcaatcaaccatgcttggcatctaccgagcctggcccaagcctgaggactggctctgacctcctgttactgctttggtctttttggcttgcaggttcttggctccgcatatttcacctaagtgagagaggctccttcctcacttcctgggctctcagggccctgtggttgaaactctcttctgcacccctcctcctgtatccagggaaaagaatcctcatgcaattgtgacttatttcctaccaaatatagtgcagcattcttcaaaatctatgagtgcattgaactcaagacagtttggcaatggaaaatgagaggtttccagtcatcatctgcccaatccgcatgtccagctgggggtctgcatttccatgaacaaatcaacagagcttttatttgtctcttgcagtttcaagttcaatgtgttcagatgtcttgtcacatccataagaaaatacaatcttgtgaatcacggaaggtctaacaaattagatttggtggctcctttattgcaaaaagcccttgattggaggtgacagctcgataaatctacatacttgtgatcagtctcttctaaatagctcataaactggtcatggttaaaggcatgaacacagagaaaattaataattttcattgctttctccatcaacagtatgtggtaaactggacttgcaaagtccatgagatgaagcatgaggcaatgacagctgggtccaccaaatttctcttgacttgaatacatggttgttttttttttttttttttttgagacggagtctagctctcttgcccagctggagtgcagtggtgcgatctcggctcattgcaagctccgcctcctgggttcatgccattctcctgcctcagcctcccgagtagctgggactacaggcgcccaccaccacac[184 bp omitted]ttgccaggctggggtacagcggcctgatctcagctcactgcaacctgtgcctcctgggttcaagcaattcccgtctcaacctcccgagtatctgggactataggcgcacaccacca[257 bp omitted]cctccgcctcccaggttcaagcaattctcctgcctcagcctcccaagtagctgggattacaggtgcccgccaccgccaccacgcccggctaatttttttgtatttttaatagagatggggtttcaccagattggccaggctggtctcgaacttctgatcttgtgatccgcctgcctcaacagatacattttcttttcttttttttttgagacggagtctcactctgtcacccaggccggacagatctgcactggtgctatcttggcttactgcaacctccgcctccctggtacaagcaattctctgcctcagcctcctgagtagctgggattacaggcgcccaccaccacgcccagctaatttttgtatttttagtaaagatggggtttcaccattttggccaggctggtcttgaactcctgacctcgtgatccgcccgcctcagcctcccaaagtgctgcgattacaggtgtaagccaccgtgcccggccgacagatacattttcaattccttttttttaaggcagggtttcattctttcacccaaactggagtgtagctgcacaatcacagctcactgcagcctggacctcccaggcttaagtgatcctcctgcctcaggctccagagtagctgggaccacaggggcatgctgccattcccagctttttttttttttttttttgtagagataggggtctcactatgttgcccaggctggtcttgaactcctggcctcaagtgatccttccacctcaacctcccaaagtgctgggattacaggtgtgagccaccatgccctactccagttccttttaaggggagaagtgctatgcagtaagcacagggtactgagagaccacagaacagcaagttaaccagatgtgggtttggaaagacttcctaggccttgaaggatgagtaagagttagctggggaagggggagtcgagattagatacagtctaggcaaaaggaatagtatgtacaaagacaagaaggaagaaagaacatggtatgttcaaggaactctaagatattgtgtgactggaagtcagagtttgaagatactggaaattaccagtagccataccattgcctcgggtgccatattgaggagctttctccatattgtggtgaatgagaattcaaaatattcaaacagaggataaacacagtcagatatgaatgttaaaaggatatctgtgtatacctaacagaaaacccccaagggttagaatgaaaaggaaaaagacatttaaaaggaaatataaaatttgaacagcattataaactaactaggcctaaagacatctataaaacactctacccaacagtaacagaatgcatattcttctcaagtgcccatggatcattctgcaggataggccacatgccaggccgtaaaagaagccttaataaatttaaaagtattgaaatcatacatagtatgttctccaaccacaatggagtgaaattagagataagttaggcaaaattttgggaattttgcaaatatatagaaactagacatggagttggctgtcctgtagggaaaaaaaaagaagttaaacatactcatatataaccaatgagtcaaagaagaaatcataagttagaaaacgctttgagatgaatgcaaattatgacacaatataccaaaatatgccaatatactaatataccctagtttatgggatgaaactaggctgggtgcggtgcctcacatctgtaatctcagcaatttgggaggctgaggcaggaggattgcttgagcccaggagtctgagaccagcctgggcagcatagtgagaccctgtctttaaaaaaaaaaatttaagtaaataaaaataaaatagaaactaaagcagtgctttgaaggaaacatatagctgtagacccctaaaaaaaaaaaaaaagaaaagaaaattaaacccaaagccatcaaaggaaggattaacaaagattagagcaaaaattaatgaagtggggaacagaaaaacatagagaaaatcagcgaaaccaaaagttggttctttgaaaaaaaaatcaacaaaattgatgaacatttacctaaatggactaagaaaaaagagaacgcactcaaattactaaaatcaaaaatgaaagaagggaaataaggactgactttacagaaataaaaaggattataagagaatacaatgaaaaactgcatatcaacaaattagataatttggatgaaatggaaaacaaatttttttttttttagacagaatcgcattctgtcacccaggctggactgcagtggtgtgatctcagctcactgcaacctctgcctcccagattcaagcaattcttctgcctcagcctcccaagtagctgggattacaggcatgtgccaccatgcccggctaatttttttgtacttttagtagagacgaggtttcaccatatttgccaggctggtctcgaactcctgaccttgtgatccacccacctcgacttcccaaggtgctgggattacagacgtgagccaccgcgcccggccagaaaaattcttaaaaaggcacaaactacaggaattgactcaagaagaaataggaactctgaagagagatgtaacaaatagtttgtgccagtagtcaataacttccaactaagaaaagcccaggactagatggtatcactggtgaattataccaacatttaaagaggaattaacaccaatccttctcaaattcttccaaaaaatagaagaggatataacacttccaaactcattctgtgaggcgagcattaccctaatactaaagccagacaaagatactacaaggaaagaaaagtacagcccaatattccttatgcatattgatgcaaaaatcttcaacaaaataccagcagctgaattcaacggcatattaagaggattatacaccatgaccaagtgatttattcctggaatgcaaggatgattcaacacatgaaaatcaatcaatttaatgcatcacgttaacaaagtatttgataataaaaccagatgaagatataaaaggcgcagtggctcatgcctgtaatcctagcactttgggaggcagaggcgggagaactgtttcaacctgaaagttcgtgaccagcctgggcaacatagcaagacctcgtctctacaaaaagaaaaagaaaaagaaaatcatatctcttatgaacataagcataaaaatcctcaacaaaatactagcaaactgaatctggcagtatataaaaagattattctccattacaaagtggaatttaccaagggatgcaaggttggcttaacgtctgaaaaatcaataatgcgatacactatatcaatagagtaaaaaacaaaaagcaaaacaatcatttcaacagatgcagaaaaaagcatttgacaaaattcaacacctcttcatgataaaataaataaataaacttagaaatagaaggaaacattctcatcttgacaaggagtgtctatgaaaaaatccacagctaacatcatacttaatagtgaaaaactgaatgcttttctcttaagttcaggaaaaaggcaaaaatgtccactctcaacacttctcttcaacattgtactggaagttctagccagggcaagtaagcaaggaaatgaaataaaacacatacagattggaaaagaaaaagaaaaactatatttgcaggtgacataatttcatacacagaaaatcctaaggaatttactaaaaactattagaactaataaatgaggctgggcacagtggcccacgcctgtaatctcagcactttgggcggccaaggtgtgtggatcacttgaggtcagcagttcgagaccagcctggccaacgtggtgaaatcccatctctactgaaaatgcaaaaattagcttggtgtggtgccacaaacctgtaatatcagctactcaggaggctgaagcaggagaattgtttgaacccgggaggcgaaggttgcagtgagccaagatcgcgccactgcaatctggcccgagcaacagagcaagacactgtctcaaaaaaaaaaaaaaaaaaaagaacaacatgtctagaaataaacttaacaaaaggagtgcaagatttatacactaaaaacaaaacattattgaaagaagcacgggaaagacattctgtgttcatgaattggaagactaatactgttaaaatgacaataatctccaaactagctaagatagatgcaatctctatcaaaatccaaggtaccttttctttccagaaattgacaggctgatcctaaaattaatatggaaattcaaatgacccagaatagtcttgaaaaacaaagttggaggactcacagttccccatttcaaaacttactacaaagctacagtaatcaagacagtgtggtcctagcataaggatagacatagatcaatggaatcgatttaacagtccagaaataaaccttgtagtttacagtcaatcgattttcaacaagagtgttgtcttactccattcaggctgctataacaaaatgccataaactgggtagcttataaacaacaaaaatttatttctcacagttctaaaggctaggaagtccacagtgaaggtgctggtagatttgtcagaacccactttctggttcataaatggcgctttctcactatgttctcatgtggaagggtctagctacctctctggggtctcttttataagagcactaaactcccaaaggtcctacctcctaatactatcacttcattaggatttcaacatatggcttggggacgaaggagacacgaatattcagaccatagcaagtatcaagacaattcaatggggaaagaatagtcttttcaacaaatgatgctgggacaactggatattcacatgcaaaagaatgaaacaggacccctactacataccatatataaaaatgaaaatgggccaggcacggtgggtgactcatgcctgtaatcccagtgctttgagaggccaaggtggaaggatcgcttgggcccaggagttcaagaccagcctgcacaacatagctagaccccatccctacaaaaaatgataataaaaattagccaggtgtggtggcacacacttgtagtcctagtctcagctactcaggagggtgaggtgggaggattgcttgagcccaggagttagaggctgcagtgagctttcatcatgccactatgctctagcctgggcagcagagtgagagaactcatcccccccacccccaaaataaaaattaataaaaatttcaatggacgggcttgatggttcatgcctgtactcccagaactttgggaggccaaggcaggaggatcgcttgagctcaggagttcaagaccagcctcggcaacatattgaaaccttgtctctacaaaaaattgtacaaattagccaggtatggtggtgcacacctgtagtcccagttacttgggagggtgaggtgagaggatcacttgagcccaggaggttgaggctgctgtaagccgtgatcacaccactgcactccagcctaggtgacagagtgagaccctgtctctcaaagaaaaaaaaaaaattaaaatgaatcaaagaccttaatgtaagaactaaaatttaaaaacagaagaaaacaagagtaaaccttcatgaccatgtattaagcaatgaattattagatgtgacaccaaaggcacaagcaagaaaagaaaaaacagataaattggacttcattagaatttttgttccttataggataccagcaataaagtgagaagacatcccacagagtcggggagaaatatttacaaatcatatatctaataagagacttataaatgaaaatgtatgaaaaactcttacaactcaaaaataaaaagcaaaataactcaatttttaaaaaggggaaaagatctgaatagacatttctctaaggaagatagacaagtggccaatgagcttatgaaaagatgctcaataccattgggccatcagggaaatgcaaatcaaaactacagtgagataccactttatacccactagaatggctataataaaaaaaagaaatataataacaagagttggcaagaatgtagaggcattagaacactcgttcacaactgctggtaatgtaaaatggtgcaaccatttaggaaaatagtttggcagttccccaaatgttcaaaatagttaccatatgacccagcaattccacccctctcaaactaggtatctacccaagagaaatgaaagtatatatccacagaaaaccttgtacatgaatgctcacagcagcactcatcataatagtcaaagaatggaaatacccaaatatccatcaatggataaatgaataaataaaatgtagtatatccatacaagggaatattattctgcaatataaaggaattaagggccgggcgcagtggttcacacctgtaatcttagcactttgggaggctgaggtaggtggatcacctgaggtcaggagttcgagaccagcctggacaacatgttgaatccctgtctctactaaaaatacaaaaattagctgggcgtggtggtatgtgtctgtaatcccagctactcagaagactgagacaagagaatctcttgaacccaggaagcagaggttgcagtgagctgagattgcaccactgcactccagcctgggtgacagagcaagactccgtgttaaaaaaataaaaaataaaaataaaggaatgaagttctgatacatgctacaacacggattaaccttgaaaacatgatactaagtgaaggaagccagtcacaaaaaaaaacacatatcgtatgattccaattttatgaaatgttcagaatagagaaatctatagagacagaaagtagatttagtactgtcctggggctggaagaattaggaaggaaatgaaaagtaatcactaatgggtatggagtttctttctgaggcagtgaaaatgttctaaaattagatagttgtgatagttgcacatatgtgaaatactgaaagccattgaattgtacattttaaaaatgtcaattgtggcctggcgcagtggctcacacctgtaatcccagcattttgggaggccgaggtgggaggatcacctgaggttaggagtttgagaccagcctgaccaacatggagaaaccccatctctactaaaaatacaaaattagcagggcgtggtggtgtactcctgtaatcccagctacttgggagtctgaggcaggagaatcgcttgaacccgggaggcggaggttgcagtgagcgagatcgcaccattgcacgcgagcctgggcaacaagagtgaaactccgtctcaaaaaaaaaaaaaaaagtcaattgaaagatatgtgaattatatgtcagtaaagctgttttttaaataaatctttgtggtggctggtatggaaaagaaactggaggaggtgaaactggaggtcacagaagtgactggtgcatggtccaagcaggagaagatgaggcctgagctggaataggatttgtggactggattcaagagagattcaggatagaggtaggccaagacttggtgtcaattcatttttggcatgattcctggttccatagtgtcttgatccattttgtgttgctatcaagaaatacctggctgggcgcagtggctcatacctgtaatcccagcacttcgggaggccaggcattcgagaccaacctgactaacatggcaaaaccccacctctactaaaaaaaaaaaaatacaaaaaattagctgggcgtggtggcatgcacttgtaatcccagctaaatgggaggc[137 bp omitted]aaagaaatgatgtttatttagctcatggctctgcaggctgggaagtctgagaagcatggtgtcagcatctgctgggtttctggtgagggccttgtgctaggtcaaaacgtggcagagaaggtcaaaggggaagcagacgtggggaaagagagaaacctgaggggcatcctggctttataacaagccacttgtgtgggaactaatcctgtcctgccagagtgagaactcactatcccgaaaacggcaccaagccattcatgagcaatccgcccccatgactcaaaacacctcccacgaggccccacctcccaacaccaccactttgggaatcaaatttcaatgtgagttttggtggggacaaacaaaccataaaaaccatagcacatagtggctgtcctgacactaccagagtctgtatccatgcactgctctccatctccacaactattgcactaatccaagccattgtcatcactcatgtcaactactgcccttttggatgatctacctgcatcgactcatgttccctgccaatctattctctacactgaagccacaatggtcttcccacactgtaagtctgatcatgtccttcctgtgctttaaactcttcaatgatttccctttgcacctagaataaagaccaaaattcttgacccacttaactgtccctgtatgtcctggcccctgcctacctctcttacctctcccttactctctgtactctaagtacactgcactgctttcaaatgcctcacctaccacaggatctttgcacatgctgtcctcgctatggaatgcttccatctctgcttcacctgttgactccaactcttctctcagtcatcacctcaatcatcatttcttcctggaagccttccctgatggctccagttcccctacttttttttttttttttttttttgatacagactctcactgtgttgcccaggccggagtgcagtgacgcaatctcagctcactgcaatctctgcttcctgagttcaagcgattctcctcccttagcctcccaagtagctgggattacaagcgcccaccatcacacccggctaatttttgtatttttagtagagatggggtttcatcatg[137 bp omitted]tcacggcccttatcacagttgcagtttcacctttatttattgtatcgtttgattattgtctgtgtctctccttaggtcataagccccataagaacaatatctgtggccattttgttgaacgttgtatctctgatgcctaagacaccatttggcacatagcagatcctgaattatatttgttaaagaaatgaattaacctcagggacgattttaaatgctaattaaagcaacaatgatctatcctattgtgctcatagattggcaaagattaaaaagattgaaaatacttagcctgggcaagcgttgaagaaaatgagcactcccatacgccgggtggtgggtgtgtaggccaattggaccttcatatgttcacattgtttgaccctgcaattccacctatgagactttgttccaagaaaacgatcactcgtgcataatgatatacacaggaagatgtttagtgaagcaccatttgtaataagagaaagttggaaacaacctaaatcttcaacaataggatatggcatggcatagtggctcacacttgtaatcccagcagtttgggagactgaggtaggagaatcccatgaggccaggagtttgagaccagcctggccaacacagcgagactccatctctacaaaataattttttttttgagatggagtctcctctgtctcctcccaggctggagtgcagtggtgcaatcttggctcactgcaacctctgcctcccaagttcaagcgattctgttgcctcagcctccagagtagctgggactacaggcatgtgccactacgcccgggtaagttttatatttttagtagagaagaggtttcaccacagtggtcaggctgctctcgaactcctgaccttgtgatctgcctgcctcggccttccaaagtgctgagattacaggcgtgagccactgtgcctggccaaaagaatttatttttatttacttatttatttatttatttatttttgtggagatgaggcctactatgttgcccaggctggtctcaaactctcttaagctcaagtgatcctcatgcctcagccttccaaagtgctgggattacaggtatgagccgctgtgcctggcctacacattttttttttaattagctggggctgagctcggtggctcaggactgtaatcccagcactttgggaggccaaggagagtggatcatctaaagtcagaagttcgagaccagcctggccaacatggtgaaaccctgtctctactaaaactacaaaaattagccggacatgctggtgggtgtctgtaatcccagctactcaggaggctgaggcaggagaatcacttgaattcgagaggcagaggttgcagtgagccgagatgaggccactgcacttcagcctaggagacagatcaaaacactgtgtcaaaaaaaaaaaaaaattagctgggcatggtggcatgtgcctgtagttgtagctcctcaggaggctgaagcaggaggatctcttgagcccaggagttcaaggctgcagtgagtgccactgcactccagcctgagtggcagaaaaagaccttgtctcaaaaaataaaaataaaaaataaaaaattaggatattagttgtattaggccattcttgtgttgctataaagaaatacctggaactgggtaatttatataaaaaaaaagaggtcttattggctcacaattctgcaggctgtacaggaagtgtggcactggcatctgctaggctttgggaaagctttagggagcattttaactcgtggaaaaaggcaaagtgggagcaggtgtctcacatggcgggagcaggagtgaggaaatagaaagggcaggggaaggtgccacactttacaacaaccagatcttgtgagaactcactatcacgaggacagcaccaagccatgaagggatccaccccataacccaaataccccaccaggccccacctccaacattggggattaaaattcaacataagatttgggtgg[143 bp omitted]aaccctgtctctactaaaaatacaaaaaatgagccagacgtggtggcatgcacctgtagtcccagctgctcgggaggctaaggcaggagaatcccttgaaccttggaggcggaggttgttgcagtgagccgagatcacaccactgcactccagcctggtgacagcgcgagactgcatctcaataaataaataaataaataaataaatcgtggtgcattcatacaatagaatactgtgtggcctttaaaaatgataatgtaaattgtatttattgatgtgattagatgttcatgatagaatctttagtaaaaataggcagttactaaaaagtatgatggggccaggcgcagtgtctcacgccagtaatcccagcattttcagaggccaaggcgggcagatcacctgaggtcaagagttcgaaaccagagctggccaacatggtgaaaccctgtctctaataaaaatacaaaaattagccaggtgtgatggtgggtgcctgtaatcccagttactcaggaggctgaggcaggagactcgcttgaacccaggagggggaggttgcagtgagccaagatcgcaccactacactccagcctggcaacagagcaagactccatctcaaaaaaaaaaaaaaaaatttttttaaagtatgatagtaagatactaggtcttctattttaatagtatgtaatattgatatataaatgcataaaaaaactgcaaggataaatacaaagctatttactatgagttgttttggaggtccttaatattttactctacatgattctatatcatcttaaaattttgcgaggccatggtgatacacacctgtaatcccagctgcttgggaagctatggtgggaggattgcttgagcccaggagttcgaaaccagtctgggcaacaatagcaagacccacccccctcttaattaaaatattttttaaagtattttatgaagatgtactcataagctgggcgcagcggctcacgcctggaatcccagcagtttgggaggctgaggcaggcagatcacctgaggtcagaagttcgagaccagcctgaccaacatggagaaaccctgtctctactaaaaatacaaaaaattagcccggtgtggtggagcatgcctgtaatcctagctactcaggaggctgaggcaggagaatcccttgaacccaggaggcgggggttgtggtgagccgagatcgcgccattgcactccagcctgggcaacaagagcaaaactccgtctcaaaaaaaaaaaaaaagaaagaaagaaagaaaatgtactcaggtatcattgcataattgaagaagttttaaatcaaaaaaaggaaaagatagaataccaatagtaaatatgtgtatatgaccatacgtatatgtgctgtaggtaaatatacatataagaaggatcagccaggcacggtggctcacacctgtaatcccagcactttgggaggccaaggcaggtggatcatctgaggtcaggagttcgagaccagcctggccaacatggtgaaaccccatctctactaaaaatacaaaaaatagccaggtgtggtgacacatgcctgtaatcccagctactagggggtgctgaggcaggagaattgcttgaacccgggaggcggaggttgcagtgagctgagattgcgccactgcactccagcctgggcaacagagcgagacttgtctcaaaaaaaaaaaaaaaaagcatctggccaggagcagtggctcacccctgtaatcccagcactttgagaggccgagtcaggcggatcacttgaggccaggagttgaagaccagcctggccaacatggtgagacttcgtgtctactaaaaatacaaaagaaactagccaagcatggtggtacgtgcctgtagtcccagctactctggaggctgaggcaggagaatcacttgaacccgggaagcagaggttgcagttacctgagatcacaccacagcatgccagcctgggtgacagcaagatcctgtctcaaaacaaaacaaaacaaaacaaaaacaaacaaaaaaaaacaactaatatgaagctcttaacagtagttgttctggattggaggattatggatgatctttatgctccctttttgcctgtctatattttctataattagcatatattacttttgtaataagagaatgtaatcaagtatatttcattttgagaaaacattacagtgagaaataaaggccaggagagaaggactactcatgctggctagccagcccattatctctcagtaaagcacacctacgtgggaggccacattttaatcaagaagttgcttagtgaccacagaaccagagcaaagtgcctagctggatggctctaatgtcgaaagacagcaagcaatgatagcctgatgtatcatctccactgcagtgctaacctgcctgccctgaatgcagactttaaaacaccccaacacacctaaagcaccaagaacctgccctaagattgtttgatcgcattgccctggatcttccttgcttgtgtatgacttacattcgcctgactgtgtctctggctgacaataaactctcagcttcatagcctagctttgcatccgtttgtggtctggtgtctgactctttgttttagcatttgcccttggtctccttgaggcttaatttgcagcttctctctaatgaatttcagtttggacttgctccttgactcatcctgctaagctcctctagttgcaggagcccgggtaggggccctgcctctccttgttccactgctgggcaggggtaggacgtggggattcagacttacacctgacaaggctaacttcagacacattttttctttagcttataactttcagttaacttacgatcaattcttttttttttttttttaagacggagtctcgctctgtcacccaggctgcagtgcagtggcgcaatctcggctcactgcaagctccgcctcccgggttcacgccattccc[136 bp omitted]tgctgggattacaagcatgagccaccgcgcctggcctttttttttttttgaaacagagtcttgctctgttgcccaggctggagtgcagtggcgcgatcttggctcactgcaacctccgcctcccgggttcaagcaattctcctgcctcagtctcccaactaagctgggactacaggtgcacgccacaacacccagctaatttttgtatttttagtagagacgaggtttcacca[138 bp omitted]catctgtaatcccagcactttgggaagccgaggagagcagatcacctgaggtcaggagttcgagaccagcctggccaacatggcaaaaatccatctctactaaaaatacaaaaattagctgggcgtggtggcactcgcctgtaatcccagctacttgggaggctgagacacgagaatcgcttaaacccaggaggcggagattgcagtgagccacgaagaaagtgcagttatgatggggaagagggagaaaccagtggctgaagaggggcataatggggttgaggtgggggagtgttggttttgtttttcaatagtctggagcaggctttgaggcaagctagtttcaaagcagcctagggtggtggaaagggcttgagtttttcctcatcttgaccatgacaagctttcctcagcttgatctcatctccgccaggtggcagggcagcgagagccctggctcaggagccagactgcctccgctcttagcccagctccacactccacagcgtgactttagcccagttatttgtgcctcagtcttctttcaaatgggcataataagggtacatactccataggattgtcgacctaaaaagaagcagcttgggcaaaattaatgtaagtagagagtttatgtgggccaagcttgaagattgcaacctgagagcagaaagtcaagtttccctgaatgtacacttcaattactagcagttacaggtggagttttgaaggcaaaagtaggggacaaggagtggactgatgcaaagttgtttgtcaggaattctcattgatttacagaaataacattgttaagctacagactgtgggttgtagtgtctggtgtggcattattgggttaatttatagctatttatggcaatagcaagcaatttcaagagatgaatacacagttcaaagtggggagtagggcctgatttcagtctcattttaatgtctctcccggcctgacctgcattcctcagataaaaattcttttctcgggatcattgtaagaagggagatagctcccagcctgggcaacatggcgaaacgccgtctctacaaaaaatactaaaaaatgagccaggcatagtggcaagtgtctgtggtcccagctactcgggaggctgaggtgggtggattacttgagtccaagaggcagaggttgcagtgatctgagatcgcacccctgcacgccagcctgggagacagagtgagaccctgtctcaaaaaaaaaaaaaaattgctcatgcaaagatgcaaagtacttagaactgtggttgcctggcatggcacatagtaagtacctgctaggtgtgaaccgctattgttgttgctagctatgtggccttgggcatgtcacttaacctctcactttgtcattcaacctctcatttaacttctcatcattcatcacttgattaaggattcaaagtgcctttgcccgtactaggtattcagcaacactcagttcccttggttctttatatggtaataatagtattttacatatgaacacttactacactccaggcagctcatctattaccttcatcatcctagttaattatcaagacaaccatatgaggaagtgacattcggaagcaggtatccctagtttacagatgaggaaaccagggtcaaatagattgcgattggcccaagggcgtatacgaaatggctgagctgagattttacaatcctatttctttttcaaatactgacactggagtgggtgatgaccagttgttactaaatccagtggctaatcctttattgctacatggtttaaaccgattgttgctgctagctgatgatgaaaggctttgtagccttcctccgagtgggaacactttgctgcccccttgtgactcaccaagtttctgcctccaggttccccgttatttgaaaaaataaacaaataaataaaaggcccggtgctgcgacacacgcctgtaatcccagtactttgggaggccgaggcaggcggatcatgagatcaggagttcgagaccagcctggccaacacagtgaaaccctgtctctaataaaaatacaaaaattagctgggcgtggtggcacgcacctgtagtcccagctacttgagaggctgaggcaggagaattgcttgaacccgggaggtggagggtgcagtgagctgagattgcaccactgcactccagcctagcaacacagcgagactctgtctcaaaaaaaacttttttttaaaattaactatcttttctggtacagtaatttccctccagaaaaggtgttgaggtgttgcctgggagaggcaagggaaacatgattggagttgaattttgttttgttttgttttgttttaatatagaggagaaaatataggtgtctctcttttttattctttctttcttttttttttttttttttttttttgagatggagttttgctcttgttgcccaggctggagtgcaatggtgcgatcttggctcactgcaacctccacctcctgggttcaagcgattctcctgcctcagcctcctgagtagctgggattacaggcatgcgccaccatgcccagctaattttgtacttttagtagagacggggtttttccatgttcgtcaggctggtctcaaactcccgacctcaggtgatccgcccacctcagcctcccaaagtgctgggattacagacatgagccaccgtgcccggcctaaatataggtgtctcttacagcaactaggggcttcacaaaggtggcgacagtgggctctggtcttgagggatgactaaaagttttccaggcaggctaggaaggggaaggacattctgagcagagggaacagcatgggcaaaagcacggagatgtgatggagcatctcgggattttaagcgaggagagcaacatgcttagattcattcattctctgattcaacacatatgtgtcacatactgtgctgggtggtgacaatgacggtagtgaaaaacaccaagtccctaaaattatggagcttactttctagggaggtagatttgaagcaaatgcaagtacgagatgcctctggataaaaacaaagcaggggatgggaacagagagggaccagagggtgttattttcaacagggtggtcagggaggccttccctgagcaggtgacattggagcaggactgaatgaagtgggggagcctgcttcatgagtgaactgggaaagatcacacgaggcagagggaactacaggtgcaaaggccctgaggtgggagagtgttcggtgtgatcaaggagccagaggcggggtggtggaggactggagcatcctcagtgcaggtcggggtggggatgaagttggtaggagagggaggaggtgagattgcagaagactcagtcatgttttcatggaggaccttgtgagccatggcaaggagtggggatctcattctaagaagggcaggaagtgtttgctgagactgtgttgagatgtgagaggaaagagaggcatttagatggctggcagattttcacccaagcaactaggaagacttcactatggatgggctaagtttgagaagcttattagagctccaaggggagctgtcagcaggctgctggacagcagctggatctgtgtgtctggaattcagaggaaggatcggagcagcaggcgtctgtgcagaggggtcattgaaagacctggatgagatgagattctcaagggagcgagtacatagagacaagtggacgaggtccgagccccatggctccccaatctccagactctagaggatggagccagcaggaccagcagaaggaaggcactgaggaatgactgactggctagggagctcaaaggaaaaccaggagagctgggtgtcccagaagccaagggaagcaggagttgcaaggaggatggggtgatcgacaatgtccaatgctgctgagagggtccagtaaggtgaggactcagacccaactgctggatttgacagcataaagggagggcatggatgaccttggtacactctagcttcatgggcatgtgatctgtgtagtgggacagggccccactcttagcagggtcctgcaattggtctaatgcacttctgagaccctgttgaatttttttttttttaagacagagtctcactctgtcgcccaggccggagtgcagtggagcaatctcagctcactgcaacctccgcctcccaggttcaagcgattctcccgcctcagcctcctgagtagctgggattacaggcatgtgccaccagacccagctaatttttgtatttttggtagagacagggtt[132 bp omitted]tgagttgaatatggaacctctctcaaaacatatatccatccagaatgtgaccttatttggaaaaggggtctttgcagatgtaattaaggtaaaaatgttatgacgagattgtattggattagggcaagccctaaatccaatgacaggtgtcctaataagggaaaagaaagggaaaagacacagagaggtgacataaagacataggcagaggccgggcaccgtggctcacacctgtattcccaccactttgggagactg[134 bp omitted]tgaggcaggagaatgaagtgaacccgggaggtggagcttgcagtgagccaagatcgtgccactacactacagcctgggtgaatccatctcaaaaacaaaaacaaaaacaaaaaacaaaaaacaaaaacaaaacaaaaaaaaaattagctggacgtggtggcacatgcctgtaatcacagctactcggggggctgagacaggagaatcacttgaaccctggaggcgaaggttgcagtgaactgagatcgcgccactgcgctccagtctgggcgacagagtgagactttgtctcgaaaaaaaaaaaaagacaaaggcagagattggagtgatgcatctacaagccaaggagcatgaaggattgcttgcagccatcagaagcttgaaaggaggccgggtgtggtggctcacgcctataatcccagcactttgagaggccaaggcgggtggatcacttgaggtcaagagttcgaggccagtctggccaatatggtgaaaccctgtctttactaaaaatacaaaaattagctgggcgtgacagcgcatgcctgtaatcccagctcttcaggacgctgaggcaggagaatcgcttgaagctgggaggcggaggttgcagtgagccgagatcctgccattgcaccccagcctgggtgagagaaagactctgtcgcaaaaaagaaaaaaaaaaagaggccggatgcagtggctcacgcctgtaatcccagccctttgggaggcc[136 bp omitted]gaggcaggagaatggcatgaactggggaggtggatcttgcagtaagccgagatcgcacccgtgccactgcactccagcctgggtgacagagcgagaccacgtcttaaaaaaaaaaaaaaaaggccgggcgcagtggtaatcccagcactttgggaggcctagacaggcggatcacgaggtcaggagatccagaccatcctggctaacacggtgaaaccccgtctctactgaaagtacaaaacaattagccgggcgtgg[135 bp omitted]caaaaaaaaaaagtgttcacatccaagttctcatttgatccttccaaaaggcctatgaggtaataaagtaattcctttcatgtccatttttcagatgacaaaatggaggttcagagaggttaagtaatcactcaaggtcacacagccagtgaccagcagacctagaactccgatcacaataagatctttacccctcttcgtggctgcccattttagccagcttttttttttttttttttttttagacgaagtctcactctagcccaggcaggagtgcagtggcataacctcagctcactgcaacctccacctcccgggttcaagcaattctcgttcctcagcctccctagtagctgggattacagacacacagcatcacgcccagctaattgttgtatttttagtagagacggggtttcactatgttggccaggctggaacttttggcctcaagtgatctgcttgccttggcctccaaaagtgctgggatcacaggtgtgagccacctcacccagcctttagccagcttttgacgcacaacgagtgggggtagcaaattcttgggcatgtccgcttacaaatgtggaacccaatgtttctatgtggggtggtggtggggaggtggctgctcctctagcaacagtgatccaggccagcccttggcaggacttcctcaccagagtcggctgcaaagccagccagctggcagccggccaggctcatagagtgaacccacttggagccgagagccccacagagggcacagcaggggcatgaggtccaacaaactcaggctgtgtgtgcttctgccccagagaatacaacggcactgggagagacagcagccacagcttcccgagaagcactggaatcctaggagcggctgccgggcaggggcaggcaaggcagacagatggaagagtgcccaggctgcatcatggtagcagtttgaggttctgttgaaggagggaagtgacaagctgggctgagtgacaggcatggatgagagggcagaccaggctctggagaaaacagcacatgaacccatctttagtgacagtgaactgagcagagaaatgtcactttcaggcctggaaatggccagggaggcataatagtgactcctgcagggggcttctcctcaaccgggagctgggcgtccagggcaaggtggccaggcttgtgccatctcaactacttgggaacaaatagacttggcactctatgtttagccaccaaagtcaagaccaggagccccgaagtcccatcccccaaggagctgaggagcccagatgctagaaagagggccacaggatgagcagggccagcagctgcctggcaggacatctgtcacagcccattgggcagcaaccaagaggagtgcggaggctacgcggccccatttgctgaaggggagggctgcagactgctcatctgggagagggacagatgaacccagagccagccaaggaggtcacagcccagtcagatcacaaaacaaaacaaaccaaacccagctctcattaactgaagcttggcacatgctgggcattgtgtgatgtgctgtctttggaagagctgccttaattcgtaggatagctaaagtgtaattattatgtgattacaccttattatgtaattattagacagaacccacttggagctgagagccccacagagggcacagcaggggcgtgaggtccaacaagctcaggctgtgtgtgcttctggcccagagaagacgacagcgctgggagagacagcagccacagtttctctagaaacactagaatcccaggagcagctgctgggcaggggcagatgagggggcaggtgtcattatcatgacctccactttatagatggggaagctcaggtacaaagaagtaaagtgccttatataagtcacgtagttaagtcttcaggctgagattcaaaccaggtctgtctaactttaaagcctgttttgttcactctccctggcagggctattataaccattacatgaaataaaatatgatattagtaatagtgaaggcagccgggcatggtggctcacgcctgtaatcccagctaagatgggcggatcacgaggtcaggagatccagaccatcctggccaacatggtgaaaccccatccctactaacttacaaaaaaaaaaaaaaaaaaaattagccaagcatggtggcgcagtcctgcagtcccagccactcaggaggctcagtgaggcaggggaatcgcttgaacccgggaggcagaggttgcagtgagccaatattgcaccattgcattccagcctggcgacagagcaagactctgtgtcaaataaataaataatagtgaaggccaggtgcggtgcctcacgagtgtaatcccagcactttgggaggctgaggcaggcggatcatttgagatcaggagttcaagagcagcctggacaacatggcgaaaccccatctctactaaaaatacataacttagccggaccccaggaggtggagtttgcagtgggctgagatcgcaccaccgcactccagcctgagtgacagagcaagactctgtctcaagaaaataaaaaataaaaaaaagaaagaaatgggccaggtgcagtggctcacgtctgtaatcccagcactttgggaggctgaggcaggcagatcacttgaggccaggagttcaagaccagcctgggcaacatggtgaaaccccatctctactaaaaatataaaaattcactgggtgtggtcgcgggtgcctgtaatctcagctactcgggaggctgaggcgggagaatcccttgaacctggttggtggaggctgtagtgagccaagattgtgccactccactgcactccagcctgggtgacagagt[133 bp omitted]accctgtctctactaaaatacaaaaattagccgggcgtggtggcacgcgcctgtaatcccagctactaggctacttgggaggctgagggaggagaatcgcttgaatccgggaggtggaggttgcggtgagccgagatcgcaccattacactccagcctgagcaacaagatcgacactccgtctcaaaaaaaaaaaaaaaaaaaaaaagaatcttctaacctaaaagttggaaaagcccctagaagtgatgtactccaaccctcttttgtatgcaggaattcctccatgcagcctccaagaaaatactgatccagtctctgcttaagtatctccagtgatgaggaacttactatttcccaaagcagccatttacattttaagattcctatcatggttagatagctcttaatggaactgcgccaaaatctgcttctttgtcaatttcacccaggggaccaggctctgtgctgtgggaccacagagacgcacagtaatatcaactgtcaggtgctttgaagatttcaagcactctcctttttttttttcttttttttttgag[312 bp omitted]cacaacacacagtgaggaaggtattgtcctccccattgcaccaatgaagaaattgaggctcagggagacgagatgacttaccaaagggagcaggcctagtaaggtgcagaactgtgaattcagctgagggttcctgagtccaaagcccacactctttctacacctcctctcttccttgagtcccctccctctcccccatgggccagctcttcagttttttaaaggcagctctcatgttcctcatgagtcttctcctcctcagctaaacattcccagggctttcaaccatttcttatcaggagtcccatcactccaaaagctggatgggctccagaaactgagcacaatattccaggtggagtctggccggtcctgtgcagagcagacctcttgtgccctctcccctttgctctggacactgtactgccattcctgcagcctgtgttggtaggaatcaaattcctgtattggtaataaagtctcatcaatctgtcgacttacttatttttcactcataaatatgaataatttgcatgtaagtttggtctcttgttcctttgcaaaatcttcagtccccaggagccctgagaaacaagtgttatatgagcacagaaggagatgcatgaggcagcccggacacttaattatactttgaaatgtgtggagaagtgtgaaacctacccagcttgctagatcaggcatgtgggccctatctgtctttggaaggagtgcatcctccctctggatctcgatgaatgaaaccaagttgagttattgcatccgcatggatttccagcagctctgagcgtctggcagacaggaaacaaatcaagtgactattcttcccagaccgctcttgccaaactggctgtcaggggccataggaacagaactcctcatgatgccagctggccaagtgaaacagtggccaggggtagattcttccctgcaccttaagggagatgccaaacttccaaaaaaatgggaaccaccttgtgataggcactgctgagcggcaggtttcagggtcttagtatacccagtaggcagctcaactgtcctggcgaggccaggcagggctctcatgcagagatggtgtgcaaatccgttaacaatggcaccaggaccagctgcaatgctctctctccctgctgtttgtgggcaccattggccacccactgaatgaactgacccatggatagtgtcttcttttttttttttttgagatggagtttcaatcttgtttcccaggttggagtgcaaggcacgatcttggctcactgcaacctctgcctcccaggttcaagcgattctcctgtctcagcctcccgagtagccgggattacaggcgcatgccaccatgcccggctaatttttgtatttttggtagagatggggtttc[133 bp omitted]tcagcttgagatcccccttgtaccctctaccaacctgcacaaaacccccagcacatcaaagggaccacactgttagcaaactaattgtgagagactgcccacacctgccttgataagtggaaacagaaacagggtttggccacagaatgcacaggtgacaatgaaagactcagtgccagaaaaggcacaggccctttttcttgat[186 bp omitted]gtg[132 bp omitted]caaaaaaaaaaaaaaaaaaaaagcaactgacaatgtttcatattgaaatctctccagactctgcccattttaagtgtgaacaatgttcacatgaacccagcccatataagagtcactcaaatatggaggctgacaattgacaaatagcaccaacctggaggcttcaggtaattt[142 bp omitted]gaaatcccatctctattagaaaaacaattaaaaaaaacaaaaaattagccgggcgtggtggcaggtgcctgtagtcacagctacttgggaggctgaggcaggagaatcacttgaacccaggaggtggaggttgcagcaagccgagatcgcaccactgcactccagcctgggcagcagagtgaaccaccgtctcaaaacaaacaaacaaacaaacaaacaaacaaacaaaaaaggcctggtgtagtggctcacacctgtaatctcagcactttgagaggtcaaggtgggcagatcatgaggtcaggagttcaagaccagcctggccaacatagtgtaaccccgtctctactaaaaagtataaaaattagcctggcatggtggtgcatacctgtagtcccagctactagggaggctgaggcaggagaatcgcttgaacctgggaggcggaggttgtggtgagctgagatcacgtcactgcactccagcctgggcaacagagtgagactctatctcaaaaaaaaaaaaagactattttcccttgtttatttcacacaagaggggccaccatgaaacgtaaggctcagatggcagagttgagtgtgctaccaggaaaagtctccaagataagaatcctcactactatcaggctccctcatgtctgagatccctaccattagaaccactcctttgggttaaggcattgaaggccccaatcacaagacaaatatttcagtgtatgagctattgactcaacatgtgactcttgagccacactgcctggggttgaatcccaactctaccagatactagttgtgcaatcttgagcaagtcacttaacctctcaaattctttgagccttaattttctcatctgtaaaatagaggtaataagggaacctacccataaggctattttgaggagtgatatgatttggctgtgtccccacccaaatctcatcttgaattgtacctcccacaattcccacgtgtcgtgggaagaacctggtgggaggtaattgaatcataggggcaggtgtttcccgtgctgttctcatgatagtgaataagtctcgtgagatctgatggttttaaaaatgtgagtttccctgcacaagctctcttctcctgtctgctgccatgtgagacatgcctttcaccttccaccatgattgtgaggcctccccagccatgtggaactgtaggtccattaaacctcttttttctttttctttcttttttttttttttttttagatggagtctcattctgtcacccaggctggagtgcagtggcgtgatcctggctcactacaacctccacctcccaggttcaagcaattctcctgcctcagcctcccaagtagctgagatcacaggcatgtaccaccatgccctactaatttttgtatttttagtagagatggggttttg[131 bp omitted]atgtctttatcagcagggtgaaaatggactaataaaaggaattaatagtacatataaatacaaatgagctaatgaattaatacatataatacatataaacttggagcagtagctggcacatagaaagctgttatcaggccgggcacagtggctcacgcctgtaatctcagcactttgggaggccgaggcgggcagatcacgaggtcaagagatggagaccatcttggccaacatggggaaacctcctctttactaaaaatacaaaaattagctgggcgtagcggcacacgcctgtaatcccagttactcaggagactgaggcatgataattgcttgaacctgggaagtggaggttgcagtgagccaagatagtgccagtgcattacagcctgggtgacagagggaagccctgtctcaaaaaaaataaaaaagaaaaaggccagg[174 bp omitted]tgaggca[137 bp omitted]ggaatcaggccgggtgcagtggctcatgcctgtaatcctagcactttgggaggccaaggcaggaggatcccttgaacccaggagtttaagacaaccctgggtgacatagtgagacccttgtctctacaaaacaatttaaaaattagccgggcctggtagctcaagcctatagacccagctactcgggaggctgagatttgaggattgcttgagcccaggaggttgaggctgcagtgagccatgatgtgtcactgcactccagcctgggtgacagagaaagaccctgtctcaaaaaaagaaaaaagaaatcagcaccccctaaccaaaaaaataaataaataaataaagcaaataccacaaaggcct[154 bp omitted]ctcccgagtagct[205 bp omitted]gcactttaagtggataatttgccttgagagattagctaataatagtacgaagccattaggattaatgagagctttaaaatctaagcctctacaaggtggatgcatcacgaaactacagtgggagacgtccagatgatggctgcttttcgtggcagtttggaagcatatccacaaattatttgacactcctccttttgagaggaggaatctatatgccattccctcgaatctgagcagccgacagagtatggtagaggagatgctgcctaacttccaaagctatgtcataaaccgcgggcagtggctgcctcaagtgtcctggccagcagccctcagctgaggtcccagccagcagccagcagcaaatgacagacatgtgaggaaatacatctccagaggatcccaccccaaccagtgtcaagtcacccccagctctcacatcttcccagtcaatgtgccagacatcatggagcggatgctagtcatccccttgtgccctgtctaaattcttgacctccagaattcatgagcataagaaaatagttatttttcaccactaagttttgggatgaggccgggcgcagtggctcatggctataatcctataatcccagcactttgggaggctgaggcatgtgcatcacctgaagtcaagagttcgacaccagcttttgcaacatggtgaaatctcgtctctactaaaaatacaaaaattagctgagtgtggtggcatgcacctgtagtcccagttacttgcagggctgaggtggggaggatcacttgaccccgggaagtggaggttgcagtgagccgagattttgccactgcactccatcctgggcaacagagcaagattctgtctcaaaaaaaaaaaaagttttaggatgattttttacacagcagtaggaactagaagggtagtggcagagaggggccacaaaagaggcttctgggtgctgtgatattctatgtcttgatctgggtgctagttacacaagtgtgttcaatttgtaatgaccagcctggccaacatggtaaaacctcgtctctactaaaaatacaaaaattagctgggcgtggtagcgggtgcctgtgatcccagctactcggaaggctgaggcaggagaatcgcttgaacccaggaggcagaggttgcagtaagccgagactgcaccattgcactccagcctggatgacaagagcaaaaactctgtctcaaaacaaagcaaaacagaaaaccgtgtcaagctatacacttatttgtgcatttttttatgcacgtcaccatattttaaaactttacattaacaaaccctggatatacagaacataaagacacgtctctgctattttttcagcaatgccaaaagtcatgtgattttcaaaacagtactttattagatctcactgaacggaaagacacatgtttagaagcttcattcgaagtttgttacttaataacaaaaaacaaaagttcatagatccccttgaggaagcagttgtttttactatcttagtaaacatggtcaaaatagttcatttgaaacaaagtggtaataaactctaacacatttatttgtcagtaaataccattggaaggcatctagctaacattgccgaagatttgaacaaactatgagtaaatgatacagtgtaggaagttttctgtacagttggacaaaactttttcagcattttcagctttgtatttgctagatactgtttcaataataaaatccacaaagaatttatttatttattttgagataagagtctccctctgtcacccaggctggagtatagtggcagcattgtagctcactgcagcctttaactcctgggctcaggcgatcctcccacttgagccttctgagtagctgggaccacaggcgcatgccaccactccaggctatttttattttttaattttttgtagtgacagggtctcgttttgttgcccaggcttatctcaaactcctggccacaagtgatactcccaccccagcctcccagagtgttcggattacaggtgtgagtcaccatgcccagccaaaaaactacttttttgtgtgtggtctaccaaaggagaaatgtaaaggagaagatatattatgaacacaaagtgacttgtttacttttgtaacatcttataggaaaactggaaataaagatttttacactgatgaagtgctactctgacaggaaactttccaaaagtgggggtggatttcaaggtaactttactgagaaagttggcgagctatcacagcaaagatattgaagcctgaaatgtacaaagtgctataggattcattaatctggttaacggtataaaaataagacttttttttttttggaaacagggtctcactctgttgccaaggctggagtacagtagcacaatgtcgggtcactgcaacctctgcctctgggttcaagtgattctcctgcctcagcctaccaaatagctgaaattacaggcacgtgccaccaagcccagctaatttttgtatttttagttgagacagggttactccttgttggccaggctggtctcaaactcccgacctcaaatgatctaccctcatcggcctcccaaagtgctgcggttacaggcatgagccaccgtgcctggcaaaataagacttgatatacagtaatttttttttttttttagacagtctcactctttcgcccaggctagagttcagtggtgtgatctcagctcactgcaacctccacctcccaggctcatgcaattctcctgcctcagtctcccaagtagctgggaccacaggtgcgtgtcaccaggcccggctttttttttttttttttttttgtatttttagtagagatgggggtttcaccatgttggccaggctggtctcaaactcctgacctcaggtgatcctccctccttggcctcccaaagtgctgggattacaggtgtgagccaccgtgcccagccaatataccagtaaaatctttaaagaattctattatgtaagtccttaaaagagttttcaaactaaaagatgcacttttttttccacataaagatacgcatttcaaatttactgacattttcaggggtgtcttagagtagtcagaagactttttttttttttttttgccgtgaggttttgctcttgttgtccaggctggagtgcaatggtgcaatctcggctcattgaaacttccgcctcccaggttcaagcgattctcctgcctcagcctcctgagtagctgggattacaggcacctgccaccatgcccagctaatttttttgtatttttagtagagacagagttttgccatgttggccagcctagtctcaaactcctggtctcaggtgatccgccagtctcggcatcccaaagtgctgggattacaggtgtgagccaccgcgcccagccaggagacttttaaaaaaaaatcataataaacacagcccatccagttcttcaagataaagttgatattttaacaatgagtgagaaagtaactgctttggaaggaaatgcagaacaggcagagaacatttggaaaatggatgtttgtgttttcattgttatgtaattttgtggccaaaaatgatgtaagtagcatacctagaaaacctatcatatctgcacattttaaaacttcagaataaaaattcctaacctgctttttaaacatatttcaaatgtagagttttttgtgggttttcggcacatttgttaaaaacacaaaggtgcaacaagtacttaccgttttgcaagaacaaatgattgccatcagcaaaaatgaccgtttaccaactgaatttcatcagaaacctttgcataattggtgggtggaattgaaaaacaagaattatgatgtactaagcccagccaattaaatttttcttccatttggagctgtgtatctttgtgagacatcttgcttatgtgtgacatccactaaaactgagtgctgcaataaagtaagatccgcaccttcaaagagctgcattatagtgttaacctaagaacggtcatagtagcctagcacttttttttttttttttttgagacggagtcttgctctggtgcccaggctagagtgcagtggcgaggtctcggctcactacacctccacctcctgagttcaagtgattctcctgcctcagcctcccgagtagctgggacaacaagcgtgtgccaccacacccagctaattttttatttttagtagagacggtttttcaacatgttggccaggctggtctcgaacttctgacatcaggtgattcacctgccttggcctcccaaagtgctgggattacaggtgtgagccaccgcacccagccagcactttctaataacaatgatgttagatttttaaaaaatggctaagtaaagtggctcacccctgtaattccagtactttgggaggccaaggtgagtagattgcttgagcccaggcgttcgagaccagcctgggcaacatggtgaaactcatctctacaaaaaatacaaaaattagcctggcatggtgacacacgcctgtagtcccagatacttgggggcctgggggtgaggatcacttgagcccaggaggttgaggttgcagtgagctgtattcttaacactgcactccagcctggggaacagagtgagaccctgtctcaaaaaaagaaaaaaaaaaagatgttttaaaaacgaagcatatgcaatcacattctcttgtgaaaaaattaataataaaattttaatgaatatccaaatagttttgtactacaagcattataaaactgtaaattattttaaactatattttatctttgtctcatccttttaaaatttcctttttgtgtatgctttataatatacatatttcatagagtaatacacacacatcattttgaaattgcaaaatattcacgaatgttgagaatatctgctcaaaatatttttattataggggcatgcaatttaaaacgttgggacaccagccttggcaatatggtg[137 bp omitted]cctgcctctactaaaaatcaaaaaaattagctgggcgtggtggtgggcacctgtaatcccagctactcgggaggctgaggcaggagaatcgcttgaacccggaaggtggaggttgcagtgagccaagatggcatcatggcactccagcctgggcaacaagagcgaaattctgtctcaaaaaacaaacaattagctgggcatggtggcacatgcctgtactcccagctactcaggaggctgaggtgggaggatggtttgagcccaggagttagaagctgcagtgagctatgatggtgccactgcactccagcctgggtgacacagccagattcccatctcaaaaaaaaaaaaattggagattattgctttaatatctaccataatgttaagcatcatgaatgtgatgtgattagcatagtgtttggcacatattaaggcctcaatgagtgttggcttttacaacatcctctatgtaaatgagggatgcattagacccagtgtaacatgatggttaaaagtatgagccttggaatcagttgaagctggatgggtttcctgccaattactagctgtgtgaacgtggtcaattaacttcattgggcctcagattctcattagtctcttagagttgttgtaaagattaagggacataatgcactttatggcaacagctttactgagctataattcacataccatacaattcacttttttttttaaacgaagtttagctttcgttgggcaggctggggtgtaatggtgtgatctcggctcactgcaacttccacttcccaggttcaagcgattttcctgcctcagcctcctgcgcagctgggattacaggcatgcaccaccaagcccggctaattttgtatttttagtagagatggggtttcatcaagttggccaggctggtcttgaactcctgagctcaggtgatctgcccacctcggcctcccaccgtgcttggattacagccatgagccactgcgcccagcaactcaccactttaaagtgtatatttcagtgctttttagtatattcacaaggctgtgcaaccatcaccgtgtctggaattggtgggtttttggtctcactgacttcaagaaggaagccgcggaccctcgcggtgagtgttacagctcttaaggtggcgcgtctggagtctgtcccttctgatgttcagatgtgtttggagtttttttcttctggtgggttcgtggtctcacttgctcaagagtgaagctgcagaccttcccggtgagtgttacagctcttacggcagcgcgtggggagttgttcattcctcccagtgggctcgtagtctcactgggctcaggcgtgaagctgcagattttggcggttaagtgttacagctcataaaagcagcgtggacctaaagagtaagcattagcaagatttattgcaaagagtgaaagaacaaagcttccacagtgtggtaagggacgggagcgggttgtcaatgctgcttcgggcagcctgcttttattctcttatctggccccacccacatcctgctgattggtagagcccagtggcctgtttggtcagggcgctgattggtgcgtttacaatccctgagctagatacaaaggttctccacgtccccatcagattagttagatacagagttttgacacacaggttctccaaggccccaccagagcagctagatacagagtgtcgattggtgcattcaaaaccttgagctaaacacagggtgctgattggtgtgtttacaaaccttgagctagatacagagtgccgattggtgtatttacaatccctgagctagacataaaggttctccaaggccccaccagagcagctagatacagagtgtcgattggtgcactcacaaaccttgagctaaacacagggtgctgattagtgtatttacaatccctcagctagacataaagactctccacttccccaccagactcaggagcccagctggcttcacctagtggatcccgcactggggccgcaggtggagctgcctgccagtcccgtgccgtgtgcttgcacttctcagcccttgggcggtcgatgggactgggcgccgtggagcagggggtggtgctcgtcggggaggctggggccgcacaggagcccatggagtgggtgggaggctcaggcatggcgggctgcaggtcccgagccctgccccgcgggaaggcagctaaggcccagcgagaaatccagcacagcgccggtgggccggcactgctgggggacccagtacaccctccacagccactggccactggcctgggtgctaagtccctcattgcccggggccggcagggccggccggctgctccgagtgcggggcccgccaagcccacgcccacccagaactccagctggcccgcaagcgctgcgcgcagccccggttcctgctcgcgcctctccctccacacctccctgcaagctgagggacctggttctggtcttggccagcccagaaaggggctccctcagtgcagcggcgggcggaaggactcctcaagtgccgccaaagtgggaacccaagcagaggaggcgccgagagcaagcgagggctctgaggactgccagcacgctgtcacctctcatcaccactatctaattccagaatattttcaacacccccaaagaaacccatacccattagcaatcattctctattctccctcttccctcatgcctgccttgacaaccactgacctactttctgtttgtatggatttgcctcgtctggacatctcctgtaggaatcagaagagtcttttgtgtctggttctttcacttagcatagtatttttcacattcctccatgttgtagcatgtgtcagttatttcgttccttattttttatttatttattttttttgagacggagtcttgctctgtcgcccaggctggcgtgcagtggcgcgatctcggcccactgcaagctccgccttcccggttcacgccattctcctgcttc[224 bp omitted]ggctggagggcagtggcgcaatcttggctcactgcaacctccgcctccagggttcaagcgattctcatgactcagcctcccaagtaagtgggattacaggcgcccaccaccacgcccagctaatttttggggtttgttgttgttgttgtttttgagatggagtctcgttctgtctcccaggctggagtgcagtggcacaatcttggctcactgcaaccttcacctcccaggttcaagcaattctcctgtctcagcctccagcatagctgggactgcaggcacgcaccaccatgcccggataatttttgtagttttagtagagatggtgttttaccatattggtcaggctggtctcaaactcctgacctcaggtgatccacccacctcggcatcccaaagtgctgggattaccggtgtgagccactgcatctggcaatttttgtattttcttttttcagtaaagacagggttttaccatg[136 bp omitted]atggatatactatggatatcgggattgtttctaccttttggctattgtaaatagttctgctgtgaccattcatgtatgaaaatgcatatttaatgcttggcacaggacctaagtcaccagccacctaagtgcttaatgaacagtaggcagctgtaatcactgttattacagagtgctacgttaggtgatctggggtacaggatgcctggatgtcagaaatagatggctgaaggcgccaaggacaacatttacccactgcacaattttattaagagctgttcctgtcagccgtacccaaatgtacagtatggcagcatcaaacagaggcatgagcacggaccctgctctaccactttcgagacgcgtgaccctgggcaggccacttaacctccctcagccttgtgtgtgaattgcatataaatactgtcttctctacatatctcacaagcttgctgtctgggtcaagagataattaaaaatatgaaagcactctgaaaactaagagtttattattccaagccttacgtatgacagaagccaactgataaagtaaggaaggaaccactttgtactgctcactggcctccccctctctcctgatggttcacattcctttcaagatgaggccagccccctcacccctagggctagtaccttcttcccagcaactacttaagggccaatgacctgctccagggtagaagcctgaattcatataaacaaagggcttattgctgggcgcagtagctcacgcctgtaaccccagcactttgggaggcagaggtgggtggatcacttgaggccaggagttcaagaccagcctggccaacacaggggaatgacatctctactaaaaatacaaaaattagctgggtgtggtggtacacacctgtaatcccagctactcgggagtctgaggcaagagaatcgcttgaacctgggaggcagaggttgcagtgagccgagatcgtgccactgcattccagcctgggtgacagagtgagactgtctcaaaacaaaacaaaacaaaacaaaacaaaagggcctgttgctgggcgcggtagctcatgcctgtaatcccagcactttgggaggctgaggtgggaggatcgcttgaccctaggagttcaagaccagcctgggcaacatagcgagaccctgtcctaaaaaaaaaaaaaattaaacaaagggcctgccatgcctctttcgttgcctacaggttgaaacagacacagcctttctacttttctcagttgctagttggtcagagcgccctcatgtgtctccatatggtaataccttaagtcttttacaggatgtggcattcttttaatctcagtatcaataaaatgtgtaatggaaatttttttctcgtcacacttcaaagcccatgcttgactctcaggctccaattaagccattccagcttgagtttaggcaggtttcctgcttccactcaggcctacagatttcttcctgctccctgcccacccctttctccttagtcatttttagaagccctggtgtcaacttggttctaccactttctactcttccaagctcagtaagctctcaaaataagattgtaagttctttttttaactggatacatcaggtcttactgcaggattggcgggggaggggggtgggaaggtgggggtaattccaaagtactaggaaataatttttaaagtgtttaccaaatatgacttgttccatagtctaaggaaaagggatccaaaatgagatctcatgtaaaggtctgacatttgggaaggggaaagtgatgtttggcagagtacatacacacagacacatacacattatacacacaaccagacagtgatgtctggtacacatacataccactcaaacatccattcttgcacacacattcacatgcaaacagagagaaaggagctctctctctttcataggtttctcattgagaatcatgatgatatcagcacaggtctttggaggaaaggaaatttacattctatatctggaaccccaagaatgttccagccgtgtgtggtggctcacaccaccgggtgtggtgggaggccaaggtgggtggatcacttggggccaggagttcgagaccagcctggccaacatggtaaaaccccgtctctactaaaaatacaaaatttagctgagaatggtggtgcacgtctgtaatcccagctactcaggaggctgaggcatgagaatcacttgaaccagagaggcggaggttgcagtgagccgagatcacaccacactgcactccagcctaggcaacagatgggactccgtctcaaaaaaaaagaaagaaagaaaaaaaaaagaatgttccccattccctccatgaccgagggttatggacgcctgagggactttacttcccatattccacacatctgcttctcaactgttttgcactcatggatttttctgaatccataagcccccggggcaaactccattgagagcccaaggatacaccagcatttggcttcgcccaaggagcatgtttctgagaagtttcatgtaaattaaatttttgcagatcaactatgatttcctactgacatcccctaagatttctgagctgctctcttcatcaagatagattttcagtgtacgcctaacacatcagcttctctgttcctctgccttctgccatgctccctgagttagttaaacctcatctggaaaataaaggccaatgaaacattaagatctcttctagttctttttttttttttttttttgagacggagtctcgctctgtcacccacactacagtgcagtggcgtgatctcagctcactgcaagctccacctcccgggttcacgccattctcctgcctcagcctcccgagtagctgggactacccaccacc[137 bp omitted]gcccagccgatctcttctagttctaatagtccaagatctagtaaataaacccacaaatatattagagaggctgctatttggaaaagacatcagtattattacaatttgcaatgcaaatatctactctacctccagctttttgggaagtcatttcccagggcttgaggggtttttgccccactcccttggaggggtagcagatgtttcagataactggcatgttaattttaggtgggtgggtactatcccttctgttttccactccctctgccctactccctgctatcaaattcctgagaccctctctactaaaatagagatgggtgttgcggttctggggagtggtgtgtgcagctggtgacctagggtagaaagcacttgctaattaaagatgaaacaagttgctagggaggcaccgtggctttggtctctagcagcagagttaagcaagggcacatgtatcatgggtctgtggcactggtcaggcggctgcctttgcaatctttgaactggaaacagatattattcatgctgatagggaagagagttgcctgcttagtggtgacgaaaattaatagtccaagcattcttccatcctgcattttccatgctggcattttgacttaaaaaaaaatattgctgcagctgtttgcatattctggaagtgtgtgtgcctgtgtgcggtttggtgtttacagatctggggttgcggagaggagtctccagagcaacggaagtagctgcttgtcagtcaggattcattttgaaaatgaaagcctgaaagcttggggcccattctgggcctaggcctggtctctgagaagtcagcgaaggccaggaggtggctttggccagtcaactcagtgaataaaccactgaatctcttttaaagaaaaatgaattgaccaaatctatgagttgcttttgatgtcctgcagattggagtctggagcagggatgtgggagcaggcattgaggtgctgattgtggatacatgtcccccgcccccaacatacacacacacaatcacattttcccagcctgccaaaccagaacaaggtaacaaatatttcttggataactactaggtgcacaaggatagtatgacatagctgtccaagagtttatagtttaattggcatatgagagcaaggggagagagatgtaacacaaggcagtcttggggccaaagaagtagcagaaacacagggctggggaaagagagggatcactttgggctgggataatcagaggaggcttgctagaggtggaaactaagcgcaaccttgaaagaaaagaacttcactacatagaagctcttccaggcagaggagtgtaagttatagatacgctcacgttacaagtctatccttttggctggaatttggggcttgtatgtgatttgcagttgataagccaggcttgaatgccagttcctgtgtaccagaacaaaggctatggtgtcgcacagacctgctctgccacttcctgctgggtgaccttgagcaagtagcctaacctctctgcaaactggggacagtaatgattcccagcacttgaggtcactgggaggattaaaagagttaacatatataacgcaacaagcacagtgcctggcacatagtaaatgttcaaaaccaaattacaaatgcataaactgttctgaaggaaagctctagatatttaggacttgttccaaatacgtgagggccaaggaagaaaagcttccgataccttctatcactgctgccacaggtggccccgagggagtgggctgatttggcctgagcctccatcccccttggcctagactgctggaacagtcttccgacttcctgcctctgcacctcccaaatcacctttttaacacaacctccatcatggctgtgtctctccccggctcaacaatcttctatggctccccgttgctcactgactgagctccttaagatgctgggggtgtggaggcaagaaccactatttactaagggaagggaagagcaaagagtacgctggtattaggagtgaaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtcatataggggccttgggttgggggtaaaaggcaaaagtttccaaatttacatttctgatatttccacggtcagtcatgtaatttaccttgatttgtggcctctaatgagacacacccacgggcacttttttttttccaagatggggctttcctcagtagcatttatttatttatttttgaaatggagtctcactctgtcacccagactggagtgcagtggcgcaatcttgactcatcgcaacctctgcctcccgggttcaagcaattctcctgcctcagcctcccaaatagctacaggcacccgccaccacgcccggctgattttttttttttttttttttttttggtatttttagtagagacggggtttcactatgttggctgggctggtctcgaactcctgacctagtgatccgcctgcctcagcctcccaaagtgctgggattacaggcatgagccaccacgcccagccagcagcatttatttattattactgttttttgagacagagtctcactctgtcgcccaggctggagtgcaatggcgtgatctaggctcactgcaacctctgcctcctgggttcaagcgattctcctacctcagcctcccaagtagctgggattacagacgtgcaccaccacgcctggctaatttttgtatttgtagtaatgatggggtttcgccatgttggtcaggctggtctcgaactcctaacctcaagtgttcccctgcctcagcctcccaaagtgctgggattacagacacgagccaccacacctgctcagcagcatttaaaaaattaagtttaaggctgggtgtggtggctcacagctgtaatcccagcactttgggaggttgaggcaggaggatcccttgggcccaggagttctagaccagcctgggcaatatagggagaccctgtctctacaaaaatatacaaaaattagccagttgtagtggtgcaggcctgtagtcccagctactagagaagctgaggtgggaggattgcttgagcctgggaggtggaggctgcagtgagtaaagcattccactgcactccagcctgggtgacagagtgggaccctatctcaataaatatatatatttcacttacgtaaaattctttttaaaaagttaagtttaatgcataaattgtagcttgcaaaattgctcccattcagaaatggcatgaattaaatagactacaggagggttgactgagcctgaaaggccaggaaagcagttgctggctacagacccatgctgccttggagaacagtgcattttaaaaatagcactgtatccctgaaggcttgggtagcccttgcaatggactgtcgcgttccccagccctctcatcccagtccgtgaacaccagccagaaacagtcaccactaacaaacagcccagaaacgccaccctgagcccatccatccaggtttccatctctgcctggtgggcctgtttgcttctgtgctcaaaactttcctactttcctttattttttatttttgagatggcgtctcactcttacccagtctggagtaccgtggcaacgatcatagctcattgcagcctcaaacacctgggctctggtgaacctcctgcctcagcctcccaagtagctgggactacaggcacatgttgccatgctcagctattttttttgtgtgtgtgtctgtacagacagggtctcgctatgttgcttaagctggtctcgaactcctgggttcaagtcatcctcccacctcagcctcccaaagtgctggaattacagatataagactctgtgcctggcccacactgccttcctttagtaacccatgagggtcttctcaatcatgaaatgatccaaacccccttgctgttttcagcctgtcccatgtctccaggagctacaccttaaacacacttacacagtgtaatagagcatttcctttgtcttttctttctttctttctttctttctttttttttagatggagtcttgctctgttgcccaggctggagtgcaatggtgtgatctcagctcactgcaacctccgcttccagggttcaagtgattctccctgcctcagcctcctgagtagctgggattacaggcacccaccaccacgcccagctaatttttgtatttttggtagagatggggtttcaccatgttggccaggctggtctcgaactcctgacctcaggtgatccgcccaccttggcctcctaaagtgctgggattacaggcatgagccaccgtgcctggccttcctttgtcttttctaaatgaacttcttttctttagtaattgaaggagggagggctaacagttcctagattctggcagttggcattggcatctggcattaactctctccaccccgtgcccattttatagatgcgaacaggccaactgatgcaggactgtggtttctgttccacaacctcccccttgatagctgccaaggtgggttgggcttggtgaaggctgtcagggcagggccttcttgccacttggctgagtctgcaggctcctggcttgcagggaagattggtgtgtgctgagcattcaaaggacacttataacagtagtcccctctttataggaaaagtttgaacctaagcatcttaactgttagcagatctgggggcctgagacaagcgttcaccctactctttccaaaacgaaaaccaaattacctggaagatttgaaaacggttttctgtagttttcctgtagtcagctactcttccccacagatttttctcatcatgtgatactgcctagcctatctcctccatgtaaaattgaggtttggctgcaggggacaaactcccatgctgaaaactctccgtgcctcacatcaagccgttggcatttctggtatgctttttgaggcaagactggtatgcttaccccaagagaaagagcaaattccccgagaaacctctttccaggggagcaaagtggagttaagcagatgatgcaagacttcattctagcaggggagccgagcaagaagaggagacagaagcagggctgtgatggatcagggggagggggtgctgagggagcgcaggaggcagggccggatccaggtcaagaggaatagaaaaggcttttggggaggaaggtggtgcctgatctgaggctcgaggggtgagtgggagttgaccgttgagtgtggcaagtaccatgcactataaaggcagagggtttggcaggagggtggaagctggggagtggttaatggcaaggctggagaagtggaagggggtccagatcacctaaaagaggttcatgaagtttagccaaaaggtagttgggaatcatggagggtttataagcagaggagtagcatgatgagattttggaagatcactctagcagtcacctggaggatgaatgtgccaggggagaaaactggcggcaaatgcatcgcaaaagcaaaacacttctaagcaatgctttcagaaaagtcatactaacaaggctgtatgcctgtagttgctgtttgcctgtagtcccagctacttgggaggctgaggtgggagggtcacctgattccaggaagtagaggctgcagtgaacatgatcgtgccatggcactccagcctgggcaacagagcaagaccctgtttctaaaaaaattagtcattcttcaccccaggaagttcaaagacccctgtgagggcagtgcctttcaaacttctctttttttctcctccaaagtctttgctctaatgaagcttacctagaatccccatgtgtaaatctccccacccccgcctctattctagacagacagtcctacacggtggcccctggagtaaaattcaaaaccactggtgtggtggaaagctctcagccttgcctgggttcaaatcctagctcccgattcatgaccttgagctacttgctggcctgagtggcaatttcctcatctgtgaaatgggaccaatagaatattttttgcaggtttgttctgagcattcaagataatgtatgtgcaacatctggcacactgcgtgacacatagggaataggaaataacagctgtttgaaagaatcctaaggggctcagcaggttcttgtggcaaaactccattatctgctagggtagtccaggagggatcttgtggtttacctgcattatgtcagctttaaaatgaatttgcatttattgcaagttattttccatctgtgccagaggagtgactgttcctcaaaagagatgttggctcctctgctgatgttcttcacaagctatatatttttacttttgacataacaaccacttgctgaagtgcttagtatggctaaaaaggatccagatgctaatagtcaacaagatgggaaaaggccctgaaggcattttagaattcactaagggcaggctggcacagtggctcacgcctgtaatcccttcactctgggaggctgaggtgaggggttcaagaccagcctggccaacatggtgaaaccccgtcgctactaaaaatgcaaatagtagttgtgcatggtgacgggtgcctgtaatctcagctactcaggaggcttaggcaggagaatctcttgaacccaggaggcagaggttgcagtgagctgagattgcaccactgcactccagcctgggtgacagagcaagactctgtctcaaaaggtggatcacctgaggtcaggagtttgagaccagcctggccaacatggtgaaaccccgtctctagtaaaaatatgaaaaaaatcaggcgtggtggtgtgtgcctgtagtctcagctacttgggaggctctgaggcacgagaatcggttaaacctgggaggcagaggttgcagtgagctgagatagtatcactgcactccagcctgggtgacagagcaagactccatatcaaaaaagaaaaaaaaaaaaatcactaaggccacaggcctaggaggacagaatgggtttttttggggggtggaagggaaggaaagagggtgccacgcctggggtaccactgacctgcatccctactgctctagctccagcccagtctcaaagggcctcaggtactgctctggctgctgctcccaaagccataagccttggggcttccacatggtgctaagtctgcagacttgcaaaattgaagagtgactgaaggcttggcaacttccacctagatttcagaggaagtatgggaaagcctagatgcccaggcagaagtctgctgcaggggtggtgccctgcaagaattcctaccaggggccagttgagctgtggaagcagggccaccaccctcgagaccacagaatagtgcagccaccagcagcactcatcctcagcctcaaaaagcctgtggcaatggactctaatccatgagagcagccacatgggctgctcccagcatagccatggggatggggctgctcgaggccttggcggctcaccccttgcaccagtgtgcccaggatgatgggacatggagtcaagggagatcattttggaactttaagatttaatggctggccaaggcaggacggttgctggagcccaggagtttgagagcagcctgggcaacatagtgagacctcgtctctacacaaaattagaaaattagcctggcatggtggtgcaagcctgtagtttcatctactcaggaggtgaggcgggaggattgcttgagcccaggaggtcgagactgcagtgagccatgatcgcaccactgcactccagcctgggtgacagagcgacagagcaagaccctgtctcaaaaaaaaaaaaaaaaacaaaaaacgatttaatgtctgccctactgtgttttgaacttgtgtggggcctgttaccccttgcttttggggatatttctcttttggaatgggagtgtttacccaatgtctgttctaccactgtgtctcagaagtaaataccttgattttgatttttttttttttttgagatggagtctcgctctgtggcccaggtggagtgcagtggcgcgatctcggctcactgcaagctccgcctcccgggttcacgccattctcctgcct[134 bp omitted]ggcctcccacagtgctgggattacaggcgtgagccaccgcgcccggcttgattttttttttattttttgagatggagtctcactctgtcgcccaggctggagtgcagtagcgcgatctcagcttactgcaacctccatctcccgggttcaagcgattctcccggctctgcgtcctcagtggctgggataacaggcacgtgccgtcacgcccagctcatttttgtatttttagtagagacagaatttcaccatgttggccaggctggtctcaaactcccgacctcaggtgatccacccgccttggactcccaaagtgctgagattacaggcatgagccaccgtgcccagcctgattttgattttacaggctcacagcaggaaggaacttgtcctgagtctcagatgagactttggacttttggagttaatgctggacaagttaagacttggggactatttggggggatgattgtattttgcaagagagaaggacataagatttggggggccaggagcagaatgatatggtttga[184 bp omitted]cgcggcagcacgcacctgtagtcccagctactcgggaggctgaggcaggagaatggcgtgaacccgggaggcagaggttgcagtgagccgagaccgtgccactgcactccagcctgggtgactcagcgagactccgtctcaaaaaaaaaaaaaagaaatttgacacacaatgttggaggtggggcctaaaagaaggtgtttgggtcatgggggtggacccctcaccaagggtttggtgccatttttacagtaaagggtgagttctcactctattagtccctgtgataactgatttttttttttgagacggagtctcactctgtcatccaggctggagggcagtggcacaatctcggctcactgcaacctccgcctcccggattcaagcgattctcctgcctcagccccctgagtagctgggattacaggcgtggtgacgcgcgcctggctaatttttgtattttcagtagagacagggtttcaccatgttggccaggctggtctcgaactcctgacctcaggtgatccacccacctcagcctccctacgtgctgggattacaagcgtgagccactgtggccggctgagaactgattgttgaaaaaaacctgacacttccctcctttctgtcttccttcctctatcaccatgtgatgcctgctcccctttgccttccactatgactggtgcagcctgaggccttcaccagaagcagatgctggtgccatgcttcttgtgcagcctgcagaaccgtgagctaaataagcctctttcctttgtaagttatccagcctcacgtatttctttccttccccaccaagtatttccttctttctttttttttttaatgtggcccaagatgagatatttctttttaaaaaaaatttttttttatacaaacaatgtctccctatattgcccagcctggtcacgaactcctgggctcaagcaatcctcttcccttggcctcccaaagtgttgggattgcaagcatgagccactgtgcctggccccccaagtatttatttatttatttatttttgagacagagtcttgctctgttgcccgggctggagtgcagtggcgtgatctcagctcactgcaacctctgcctcccgggttcaagggattctcctgcctcagcctcccgaatagctgggatttcaggcttgcatcaccatgcccggctaatttttgtattttcagtagagacggggtttccccatgttggccaagctggtctccaattcctgacctcaagtgatccacccgcctcggcctcccagagtgctgggattacaggcatgagtcaccgcgcctggcctacaagtatttctttatagcaacacaaaaatggactaagacagacataattgcaaccagcgaacttaccttgttcttcactcacggaagtaaaagagcaacttggtaagtgcccaccaaatattaaatatgttagatattgttttcagataaagtcataaactggagtcagagttaaacctgaaatcctctgaagagaatcaaattatacaagtccttcatctcctggccctattcatctgtgggaatgccccctaaccccagctaacataacatatattccacaccaagactccccatcttccctccttcccttcattctgacaaaggagcatgcctgtcctctttcaagatatcgctcatgctctcaaccgcctctcctctcagggtttactgacatcaattgtcttctcctgcatcttcaaacttacccacagtttagttcagtacaacagacattttatttttaacttttttcttttttgagacggagtctcactctgttgccaggctggagtgtagtggcgtgatcttggcttggctcccagcaacctccacctcctgggttcaagcgattctcctgcctcagcctccccagtagctggtgacaggtgaagacagcaggacttcctgggtcgagtggggacttggagaacttttctgtggagctaaaggtttgtaaacgcaccaatcagcactctgtaaaaacgcatcaatcagtgctctgtgtctagctaaaggtttgtaaatgcaccaatcagcactctgtaaaaatgcaccaatcagcgctctgtgtctagctaaaggtttgtaaatgcaccaatcagcactctgtaaaaacgcaccaatcagtgctctgtgtctagctaaaggtttgtaaatgcaccaatcagcactttgtaaaaatgcaccaatcaacagtgtgtaaaatggaccaatcagcgctctgtaaaatggaccaatcagcaggatgtgggtggggcccaataagggaataaaaactggccacccaaaccaccagcagcaacctggttgggtctttttccatgctgtgggagctttgttctttggtcttcacaataaatcttgctgttgctctacctttataaactgtaacactcaccgtgagcgtatgcagcttcattcctgaagtcagtgagaccacgaacccactggaaggaagaaactctggacatatctgaacatctgaaggaacaaactccgagacacatcatcttcaagagctgtaacacaccgcaagggtctgcagcttcattcttgaagtcagcgagaccaataacccactggaaggaatacattctggacacatgggactacaggcgtgctgcatcatgcctagctaatttttgtatttttagtagagatgggtttcaccatgttggccaagatgttctcgatctcttgacctcatgatccacccgcctccacctctgaaagtgctggattacaggcgtgagccaccccgcctggcctattttaagttcaggtgtacatgtgtgggtttgttatataggtaaacatgtgtcatgggggtttgttgtacagattatttcatcacccaggtactaagcctagtacccattatttagagatggagtcttgctctgtcacccaggcaggagtgcagtggcactatttcagctcacctgcaacctccacctcccaggttcaagtgattctcctgcctcggcctcccgagtagctgaaactatgccctgcctggctaatgtttgtattttcagtggagacggggtttcaccatgttggtcaggctggtctcaaactgacatctggtgatctccctgtctcagcctcccaaagtgctgggattacaggcatgaaccactgcactctcccattatttttcttgatcctcaccctcctcccaccctccactctctgataggccccagtgtgtgttgttcccctctatgtgtccatgtacaacagacatttagtaagtcattaataggagtgtcactctgagtgacaaaaaagctcaagtcttccctagccttctggctcaaacttgtctcttctcttcatagtaaagcctgtctgctgagaggtctcctcacttcatcatctccatttccttacctcttcctcagtccttaactttctgcattctggcttctgcctctatcatcccagagtaattgcttccagaaagggcgtggtggctcacacctgtaattctaggactttgggaggtcaaggcagggggatcacctgaggtcaggagtttgagaccagcctggccagcatggcgaaaccccgtccctactaataaccaggtgtggtggtacatacctgtgatcccagctactcaggaggctgaggcatgagaattgcttgaacccgggaggtgtaggttgcagtgagccaaaagaaaaaaaaaagtcccccatgatgacctcctgtcttagtccattcttgttgctataacaaaataccttagactggaggctgaggcaggagaatggtgtgaactcaggaggcggagcttgcagtgaactgagatcgtgccactgcactccaccctgggtgacagagtgagactccgtctcaaaaaaaaaaaaaaaattatcttagactgggtaatttataaagagcagaaatttgttgctcactgttctgtaggcagggaagtcccagatcaaggcaggtttggtgtctggtgagaggtggttcctcatttatggcacctttgtgtcctcacatggtggaagagatggaagggccaggcagctctctgaagccttatttatttatttatttatttttgagacgaagtctgtcactgttgcccaggctggagtgcagtggcgtgacgatcttggctcactgcaacctctgcctcctgggttcaagcaattctcctgcctcagcctcccgagtagctagcattacaggcacccgccaccatgcccagctaattttttgtatttttagtagagatgtt[143 bp omitted]gcctcatgacttaatcacttccccaaagatccctcctcttaatattgtcaccttggggattaagttccaacatacacattttttttttttttgagatagaatctcactgtgtcacccagggtggagtgcagtggcacgatctcagctcactgcaacctctgcctcccaggttcaagcaattctcctgcctcagcctcccaagtagctgggattacagacgcccgccaccacgcccggctaatttttgtatttttagtagagatggggttccaccatgttggccaggctggtctccaactcctgggctcaagtgatctgcccacctcagcctcccaaaattcttggattagaggtgtgagccaccgtgcccggcctacaacatacacatttcagagggacacatatattcatgcctttgcacctcccatctgccaaatccaagtccttatcttagttcacttcttggcagcactgaacaatgttggctacttcctcctgtttgaaactcttgtctagtcttccataacctcctatggctttaattgctggggtttaccaggatgaagttctggaagcttttctcttcactctacattctctcccaaagtcctgttttttgttgttgttgtttgttttgttttgtttttttttttttttttttgagacagatgcttactctgtcacccacgctggagtgcagtggtgtgattacagctcactgcagcctcgacctcccgggttcaagtgatcctcccacctcagcctcccgagtagctgggactataggtgcatgccaccacaccaggctagctttttgtattgtttgtagagacagggtttcaccctgttgcccaggctggtctccaactcctgggctcaagtggcccaccctcctcaacttcccaaagtgttaggattacaggcatgagccactgcaccctccctgcctctcccaaagttgttttttcccttccccacttaccctccctcactctgctccagccactcagtcctccttgctgatccttcgaacagccatgttcttctcaaccctggggttcctgcatgctgttcactctccagaaacactttcccctctcccttgctcctgacttcacctgacccactcatccttcattcacccactcatccttcatttcaggtgtcagattaaatgttacctccttggggatgtcttccctgctgctcaggctatgttaacactctacccattacactcactcatgaggccccgggcatcttttcttttttccttgagatggagtcttgctctgtcgctcaggctggagtgcaatggcgcaatctcggctcactgcaacctccgcctcccgggttcaagcagttctcctgcctc[136 bp omitted]cagcctcccaaagtactaggattctgtaatcccacagattacagaatcaaggcgggtggatcacttgagcccaggagttctcaatcagcatgggcaacatggcaaaaccccatctctacaaaatagaaaacaattagctgggcatggtggcacatgcctatagtcccagccacctgggaggctgagatgggaggatcacctgagcctgggaagtcgaggctgcagtgagccatgatcgcgccactgcactacagcctgggtgacagagtgagactctgtctcaaaaaaaaaaaaaaaagcatcaacgttagcatgtggactgctgctgagaacccactgattcgggatggagaggagtaggctaggattagagggactggtaagaggctatggtctgtagagtcagatggacagataagagagatttcatggaatcaacaagacttgtgattgactgaatgtaggggaggaggaagacagaggtggcaagggtgatgctcaggtttctgacttgagcaacagggtggatggtggtgtcatttactgagaggaagggccatgagaagaataggtttttttggtgggtaggggaaggggatcaaaacttgttttggatacattaagtttgagattggctatatgacatcgaggtgaagagatccaatagacagttggatacgtggataagcaaatcaagagagaactggaggtagctgtggggttactggagggtttttttcttttctttttttttttttgagacagagtctcgcactgtcacccaggctggagtgcagtggcgtgatctcggctcactgcaacctccccctcccgggttcaagcgattctcctgcctc[134 bp omitted]gcctcccaaagtgctgggattataggcatgagtcaccgtgcccggccaggagaggggttttattttggcttgggaggcacagcttgtttgtgtaatgacacaaaggactcaaaagaaaaggagaagtaggaagacagaggagtcaacacgaatagtcaatggatcaaagctcccaagaggtgggaagggataaggcagagcataggactaggaatttgtctcacagaggaggagactctggagtcagacagtctgattagagcttagttctaccaccttctagctgtgagaccctgggtaagtcactcactctccctgagtcttactttccttgactataatacaatggaattggccaggactggtggctcatgcctgtaatcccagcactttgggaagc[134 bp omitted]gaggcagagaattgcttgaacccaggaggcagaggttacagtgagccgagatcgcaccactgcactccagcctgggtgacagagtgagactccgtctcaagggggaaaaaaaaggaattatgagtacctgcctcataaatttgggctgatcattaaaggagataatgcatgtaatatgcttaccattgtgtcttgcacataggaacattgcataaatggtagctgttattattataacaggagtgcaggaggaaaaagagggcgcacatacaggtgagttcacaggtttggttgcaggaagttaaacacattctgttttttcttttctttttctttctttcctttccttttttttttctttttttttttttgagacagagtattgctctgtcacccaggctgcagtgcagtggcaggatcttagctcactgcaacctccgcttcctaggttcaagtgattctcttgcctcagcctcctgaatagctgggattacgggcatgtgccaccaagcccagctaatttttgtgtttttagtagagacggggtttcaccatattggccaggctggtcttgaactcctgacctcaggtgatctgcctgcctcagcctcccaaagtgctgggattactggcatgatccaccacgcccagcctactaacctcgatgatttcttaaacccaaacctgataggccactgtctacttttgaactctttaatgtttctcttggcctcaggatagaattgaagctctcacttaagacttagaggctcctcgtgatctggcgtctgcttacctctccagcctcattcctattcactacttcctgttcgcatcctctttcttcacccacgaatacatcccctttctacactcctgccatgcagtaactttcagttcccgatctcccagctttctcttgactgggccttttcacagtctgtttcctctgcataggacatgaacgttccacccggcagcctcagccgcaaaacctagctcctcgtgggcctccagggctcagtttgctcttcctcagtccctcccgtgttcggtacaggttcccaagaccctagtgccttccttgccgcagcactctgcactaggagctgtgtcggcactgtcatctgcctccatgtaggctgggagtccaagaagatgtgggcctgtggttgtggttcactgctgcagctcagcacccagcacagatacaacactatgtatctgcctcatagtctgaaacgggtgtttgagaatgaacaagtgggagttggaggcagctgaccttgaatttagatccacaggctttctgatttaactaatagttgtgttttttgtattcatttgccttcagttcccatgcccttcttcctttggagagccccgtggaaacaatttttcttttttctttcattttttgaaacagagtttcactttgtcaccaggctggagtgcggtggcgcgatctcagcttactgcaacctctatttcctgggttgaagcgattctcctgcctcagcctcccaagtagctgggattacaggtgcctgccaccatgcctggctaagttttataattttagcagagatggggtttcaccatgttgaccaggctggtctccaactcctgacctcaagcgatccacccgcctcagtctcccaaagtgctgggattacaggcctgagccaccatgcccggcctggaaacagtttttctaatgaacaccatgttagatgtacattagacagttacaaatgtggcattataggttcatgattttagaggttagcgatcaagtccaatttcctcatttcaaatggaagaaaacaggtccccaaagctgtggtggcttgttagtggcaggctagttgtagctgtaaaactgggactaagcctcagatttcttgataccagtgctctttctcctttcccataccatgctgtgatggattaaagatgaccataagtcctttgatactcttcccattgagaggtggcctctatcacactttcccttgaatctggatgggttctggaactgcttagaccaaaaaaatacaggaaaagggataacccagtctgggtgggaccagctacgtaatttgtggagcccaaactgaaaatgtgagaccccttttaagaaattaagaatttcaagaaagactgggcgtggtggctcacgcttgtaatcccagcactttgggaggccgaggccggtggatcacttgaggtcaggagtttgagaccagtctggccaacatgttgaaaccctgtc[132 bp omitted]gctctccagcctgggcaacacaacaaggctccatctcagaaaaaaaaaaaaaagggatttcaagatagcaaaatcagagcatcaagctaagcacagagccctgtgcaactgcacgaccacccccaggaagctggtcccggtgccagttttagggcccaggtcttaagagactggcagcttccagttcctgtctcttggaacacatgatcaggccagtcatcacataagcagtcatctacccaagaccatcatgccgtgagaaggccaagccacataaagcggccctgtaggatgagatgccatgtaaggagagggagaggaaggccaagcagcactaaggcacccagcaggtgagtggaaaaggcatcttggaagcgaatcctccagccccagctacccccactagatcagaaaaaaagcaatcagccaaggtcttcccaacttcctgacccaggaatggaaacaaaatgctcgtttcaggccactaggttttgggatagtttgttacacagcaatagataacaggaacacatactatctctagcattcttcaaaatgccagtgaaatgctgtcttttgaagcacaaagttctgtttgtataaagtgtcatcattctgtgattcccaaattacatactaaatatatgtgtatgcatattgcaagcatatgaatgtcactttggtgataaaaatatataaatgtggccgggcgcagtggctcatgcctgtaatcccagcattttgggaggccgaggcgggtggatcacttgaggttaggagttcgagaccagcctggacaacatggtaaaaccccgtctctactaaaaatacaaaaattagcagggtgtggtggcacacacctgtagtcctagctacttgggaggctgaggcacaagaatcgcttgaacccaggaggcggaggttgcagtgagctgagatctcaccattgcactccagcctgggcaatagagcgagactccatctcaaaaataaataaataaattaataaaataaaatataaatatgcacttcacactacggacatacattgttttggcatcagccatatcagaccttttttatttaaaatatgtaagttcagaatattttccttggcctctgtgaatacttctctatcattgtgcttataacaatgtgtgataattgtctatgtatttatctccttgactagatccatgcctttcaaactacacaagcaacctattagtggggcatgaaatccattttttcaatgaaatgggataaaataaaaacataagtatgcattgcacacaagtaagtatgaaatcaagaaacttgcaggattgcaggattgtgtgtgtgtgtgtgtgtgtgtgtgtgtgtgtgttgtggccactggaatagattgtgagatcctaagggcagggttcatgcccaacctattcaccactgcatccccagcagccagtgcactgtttggcacatgtaggtgttctgtaaatatgtgttaaatgaatgaaatttattcttgaatgctcctattaagagatgaacatcctcatcttcttgggacccttcaccctttcctaagaatagtactgggctcgagacttgtacttcagggagtcttacagcaatgtatttattattcatccattttcagttttcagtttgggtctacatatctacaccagtgtgaaatttctgttaactgcctgccggaacagaaactatctactccctccccaaatatgtcaagagtaaaaaaggagggagagagagaggaagagaaggaaggaaggaagggagggagggaaggaaggaaggaaggaaggaaggaaggaaggaaggaaggaaggaaggaagaaaggaaggaaggaaggaaggaaaggaggcagggagggaagaaacaaatatcagttataggtttatatcagaaactcttttttttctattttatatatatatattttaaatacggatggggggggcggtctcgctgtgttgcccaggctggtctcgaactcctgggctcaagtgattctcctatcttggcctcccgaggtgctggaattacaggcatcagccactgtgctgggcctataccagacattcttaaagattgctattatacaataggccaggcaattttaacacaccatctcatttaattgccaaagcaagttatagcacaatatttaccccattttacacattttacacatgctcagggaggttaagtaactcctctaaagtcacctaggctgggcacagtggctcacacctgtaatcccaacactttgggaggccgaggcaggcggatcaccagaggtcgggagtttgagaccagcctgaccaacatggagaaaccccgtctctactaaaaatacaaaattagccaggtatggtggcgcatgcctgtaatcccagctactcatgagggtgaggcaggagaatcgcttgaacccgggaggcggaggttgtggggtgagctgagatcgtgccattgcactccagcctggccaataagagtgaaactccgtctcaaaataaataaataaataaatgaaaataaagtcgcacaactactaagtgagaggtatgtatttgatgtgaactcaggcccggccagctccatagctttgtgagcgctccatgtcgctctgctgcccccatgcagttaaccaaagcacctacacgaagtgttttgctaagacaagacatcctatgaataggacattttctctatcaatctatgcggaactgacctatgtagacacaacttaaggtgtttatgatgcagacatcatcagtggagttcatcaacttttggtgatttgtaaataaaccaggaactcactctaccatcagcatgccttcttgagtgccacactttaaaatgcatatttcattaatttcacttcaggtgtaggtgtttgctcggttattttcataaatgaatactcatttcatttattttgagacagggtctcactctgtcacccaggctggagtgcagtggcacaaacctagctcattgcagcttcaaactcctgggctcaggcgatcctcccacctcagcctcccaagtagaaggactacaggtgtgtgacaccacacctggctcattaaaaggatttttttttgtagagatggggtctcactatgtttcccaggctggtctcaagctcctggtgggctcaagtgatcctcctgcctcagtcttccaaagtgctggaattacatgtgtaagtccctctacctggccttattttattttaaaataaagtcataaagttatattttagaatagttttagatttacggaaaagttgcaagaatattagagagttcctgtatagcctgcacccagttttcctatggttactttatttttaaatatttaatttaatttaattaatttattttgagacggagtcttgctctgttggcaggctggagtgcagtggcacggaccttggctcactgcaacctttgcctcccggattcaagcaattctcctgcctcagcctcccgagtagctgggactacaggtgtgtgccaccatgcccggctaatttttgtatttttagtagagacagggttttgccatgttggccagaatagtcttgatctcctgacctcgtgatctgcctgccttggcctcccaaagtgttgggattacagacatgagccactgcgcccagccaacaaatgcatttattgtacctccttcatgccagatgcagtttgttgaaagcaaagtgtagcgagcaagacatacccttctggatctatccttgtggagctcacagtctagcaaaggaggcagacatcaattaattgaccacacatgtaaccttatagttacaattgtgaaggaaaactacagggtaatttaagaggtagtaagcagaagaacctaactggactggaagaagagagggggaagtcagggaaggtctccctgtggaagtgacaagcaggttgagacctgaagaatgaatggatgttaaccaaatgaagagggagaacattccaggacaagggaatgggaggtggtactttctgttttgttttgtttttgagacagggtctcactctgtcatccaggctggagtgcagtggtgcaagctgggctcactgcaacctctacctcgcgggttcaagcgatcctccccacctcagccccccaagtagctgggaccacaggtgtgcaccatcacgcccagctaagtttatgtatttgaggtagagacggggtttcaccatgttgcccaggctggtctcgaacttttgagctcaagcaatccacccgcctcggccacccaaagtgctgggattacaggcatgagccactgcgtccagcttacctttttcttacctgtaaaatggaagaatatctagtggaattgatccttttctctttttaaaaactttttacggccaggcatggtggctcacgcctgtaattccagcactttgggaggccgaggctggtggatcacctgaggtcaggagttcgagaccagcctggccaacatggtgaaaccctgtctctactaaaaatacaattagctgggcatggtagtgcaggtctgtaatcccagctacttgggaggctgaggcaggagaatcgcttgaatctgcgaggtggaggttgcagtaagccgagattgcgccattgaactccaagagcaaaactctgtctcaaaaaaaaatccaaaaaacaaaaaacaaaaaaaaacaaacaaggctctgcacagtggctcacgcctgtaatcacagcactttgggaggctgagacaggcagatcgcgaggtcaggagtccaagaccatcctggccaacatggtgaaaccccgtctctactaaaatacaaaaaaattagccaggcgtggtggtgcgtgcctgtagtctcagctactcgggaggctgaggcagaggaatcactcgaactcgggaggcggagattgcagtgagccgacattgcgccactgcactccagcctggcgacagagcgagactccttcccaaaaaaaaaacaaacctttttacctgggagcatagactgaagttaccttgaaaatacactcctggaactaatcctttacagacatcattcaatccttacaaacctgaggtagtcaggtatgactggatataaaagtcttctaagagagcaaggtcccacagttggttcagtgatgaagctgggattcaaccttaggcttgcctgcaagaccttgaggggttactctgtccctccaaattaaaaccctggagttggaagagaactggcatcaatttagcagcttatgttgagcaccaactccatggcagctcagcctgattttatctcagcctcccatcacaacgtccctctccctgtgccaacatatggtgcatctgtgctggggactgacaccaaaacgttcttcctgctcactccctactcctcatctccttttcctagtcaggcaactgaaccaagtgctttggtgcattattaaatttcatcctcacaaccttctgagggagaccccattttgcagatgaggacgctgagggcttacaactggtgagtggtggagagcagggttttgttttgtttagttttgagatggggtcttactctgtggcccaggctggagcgcaatggcacgatctcggctcactgcagcctccatctctcaggatcatgcgattctcctgcctcagtgtcccgagtagctgggaccacaggcatgtgccaccacgcccggctaatttttgtatttttagtagagacagggtttcaccatgttggtcaggttggtctcgaactcctgacctcaaatgatccacctgcctcggcctcccaaactgctgggattacaggcatgagccaccatgcccggcccgggagcagtgtttaatgaatccagactatagtctggtgatacacagacagcagcaaactcaaccaatctgctgcctgcctctcagtaggtcaagggatgggcagtgtcatcacaagggtgacttcctgtctttcaaaacctgtcatctaatgcttcccttctttactatttcagtaccattttgaaatcttaaaatacatcgcaagttccccttccttccttcaagatgcactgatctaacccaactcccttcatagatatggggaaacaggtactggcaattgtacaagatagcgaggggccactggatccagaccccacagctttcaactcccaggctccaaataaacccctcacacacggctaaccccatgtccatgtcattttccctttctccaaatcctaatcctaccttccgagtagttgggattacaggtgcaatacttgggtgcctgtaatcccaactattcgaggtctgtagagaaagctgcctatgccattagatcttggccttgtcacttaacctccttgggctctgttagcaaacacccaacctactctgaagcagaagactgctttctaatgctctgaaatggttagaaatgtccctgtcttgtgactgccagttaattttatcaagtccctctcctttggacttgagtatcgttttttgagacagggtctcactcttgtcacccaggctggagtgcagtggcatgatcacagctcactgtagcctcgatcttccaggctcaggtgatcctcccacttcagcctcccagatagctaggactacaggtgcactccaccctggccaatttcttgttttgccatattgtgcaggctggtttcaaacacctgggctcaagcgatccacctgcctaggcccctcaaagtgctgggattacaggcgagccactgcgctcagccttgagtaacatttttaagtatgttaatatttaccaactgctgttcacagtggcaactttctttgaatatgaaggcatcactgatgcaataagaaaaaatatttgcagtcaggccggggacagtggctcacacttgtaatcccagcactttgggaggccaaggcaggcggattacctgaggtcaggagttcgagaccagcctgaccagcatggcgaaaccccatctctactaaaaaaaaatacaaaaatgagccgggcatggtggtaggcacctgtaatcccaactactgggaggctgaagcaggaggattgcttgaacccgggaggcagaggttgcagtgagcccagatcacgccactgcactccagcctgggtgacagagcaagactccgtctcaaaaaaaaaaaaaaaaagaaagaaagaaaagaaaaagaaaaaagaaaaaaaattgcagtctaggggttcaggagataggttccaaagatccctttaaagctcctaatttccttggtattctggagctcactcttcacatttctggtgagcgccatgctcttaggaattgctttttttttttttttgagacaagtcttgccgttgcccaggctagagtgcagtggggtgatctcagctcactgcaacctctgcctcccgggtctgagcaattctcctgcctcagcctcctgagtagctgggactgcaggtgcgcgccaccacgcccggctaatttttgtacttttagtagagacgaggcttcaccacgtgggcgaggctggtcttgaactcctgacctcaggtgatccatctgcctcggcctcccaaagtgctgggatcacaggtgtgagccactgtgcccagccggaattgctttcatctgaacctcctagtgtggttgtaaggcagggacccctttgctgtgcaatcccaccattaccacttgcacactttatgcagcagcccacatcttctgccacctgccttctcagctatgtccaggcagcacaggccccctatcgactgggcagggagttacagccaaaccctgttctttcccttgttgctgcagtttcaatcctaattccactggtatttgggggagctttgttccctctcacgttttctacagaaaagatctgctaaggtttgtatattggcctattcgttgttaccacttaacatgccacataatttgtctatcaaccaatgaattccaagtacctagaacagtgtctgacacaaaggtggccaataatttgttaatgcatctctctaaatatgaagttgctactggttctttgagatgttaaacataattccctgatgattcgtcagccagggaaactgcaaggggtaccgaagaagctgcactaacccagtaaaagctcaaatccacaagatttccaccatgtacattcactcagctgtagctcttcagtaagtcaggcaatagcattacctgttacaatgtcaacaattaacctagattttttttaaacaagtgaactcgcttgaatccaggaacaggggtgggcaatctttttgcataaagagcaaagtagtaaatattttaggctttgcaggccacattatctctgtgcacaagggtgcatttatatacataatacgtaagttatgcatatggctgtgaaacaagaacattttatatggacagaaatttgtatttcaattttcagatggcataaaatattctttcaactatttaaaaatgtaggaaccatatagttcacagactgtacaaaaacaggcagcagatggctggacgcggtggctcaggcctgtaatcccagcactttgggaggcagaggtggtggaccacctgaggtcaggaggtccagaccagcctggccaacatggtgaaaccccatctctactaaaaataaaattctgcgattgctatttccctgcactagacgtgaatgggggagttgattaattgtaaaactcatgtgaggccgggcgtggtggctcatgcctgtaatcccaacactttggggaggccgaggtgggtggatctcaaggtcaggagttcgagaccagcctgaccaacattgtgaaaccccatctctactaaaaatacaaaaattagctggatgtggtggggggcgcctgtaatcccagctactcaggaggctgaggcaagagaattgcttgaacccgggaggtggaggttgcagtgagctaagatcgcaccactgcactccagcctgggcaacagagccagactctgtctcaaaataaataaatacattaaaaaaaaataaaataaaatttacagaatcagtcctttacactaaacacacttcaagcacatggtagccagagaacatttctatcattgcagaaagttctactggatagtgttgttattaggtttggcagggaagggagaattcagtaattgacaaaccacaatacaacagcaattaaaaagaaaggccttacatatttattactgaatccagccaaccaacgtgttcataacagattcagagaggaaaacacgtcgaaatctccagatagtggtgacattttcagcttgatatggtaacatgatcgtgaccttcagacagcataaatatgtgtgccatctcatgtgcaattccttatagacccagcttggttcttctccaatgtctccttttggagttgtacctacacagaaaaaaatgtcaagttacaaaggcagtctgacagcaatgtagctgttcccattcacataaccttttaggtaccacaaaatacaaagggtactgcttttctctcctctaacaagtttggagttctttctggagagtaaaaaaaataattccctatgtgtttaaaaactagccaagtcaagttttatcctctcaaaataatttgaaggctaggctcttaactaggatcagagtagtggcgaagcccactctctccaagtgtacttgtacccacttttgattcaatggacctggaggtacacagacatactctgaaccccctcataatgggtcacaaacatataaaagctcccgcatgatattttttttgagacagagtcgcccgcccccccaacaccacccagctaatttttgtatttttgtatttttagtagaggcagggtttcaccatgttggccaggctggtctcgaactggctggacttcgagatccacccgcctcgtcctcccaaagagttgagattacaggcatgagccactgcacctggcctcgcatgatctttacaatcgatcaactcctccattcacgtctagtgcagggaaacagcaatcccagaattgtccatgtcaatctgtcatgattttaccctcataaaggcaaaatcaaaaatgattaacacggcttttctttcagcaggataatggcagtacttccacaaaatgaagcactgtaattgcaacctgctttcaaaaacatttttaacgctggaagatagctaaaacaatgaaaatcattccattgggtcaattatctgggtcaagggtatataatcttacgtacaaaataccttcccaattctaggagaccacagagtttaatagcaggttatttattgaactaggcgttgagttttacatacatttttctttttttgagacagggtcacactgttgcccaggctacaatgcagcggccggatcacagctcactgcagcctgtgaattcctgggctcaagtgatcctcccacttcagcctgctaaatagttaggactacaagcacgtgccaccaagtccagctaatttatatttttggtagagatggacgggggtggtctccctatgttgcccaggctggtctcaaattcctggcctcaagcaatcctcctgcgttggcctctcccaaagtgctgggattataagtatgaagcactgtgcctggtttatatatacttctttcactcttcacaagcaggtcccaccatcaggcaggacacagagaaacccacgttcaagtagatgtatcaaataataaaggacagtgtctagtatccagtaaacaaatggtaagcaattaactagcccataacattacaatgggtggcaattttcacatctaactagctaaatgaaccaaggaaataggccctcaactttagccctaagaagccacccctttaagtcttcttagcaaaccaatcccactagctttgccatacaagtcgaatcaagttctggctgggcgcggtggctcatgcctgtaatcccagcatgttgggaggc[134 bp omitted]gagcaagagaatcgcttgaacttgggaggcagaggttgcggtaagccaagatcacaccattgcactccagcctgggcaatgagagcaaaactccatctcaaaaaaaaaaaaaagagaaagtgctttgactagcctgggcaacatggcgaaaccccatctctacaacaggtacacaaattagccaggcatggtggtgaacgcctgtagtcccagctactcaggaggaggctgaggtgggagggttacaccactgcactcagcctgggtgagagagcgactgctgaaccttgggcaactcttgctgattcttgatgctcccttcaaaacctgtctcaaggcccatcaggaccaaagagcgatgggctgaaaaagccatgcaggagactgtttcaggcctagctttccctggagttagtctagatgaccttggaggtccttcatagcaattctagtaatgtttttcctttgagatcaactacttctgcagtagaggacagttttccaatcttttctagtctctttttagaaaagagaaacatctaaaagactgggctaggtgtgatggctcacgcctgtaatctctgcactttggtagggtgagacaggaggattgcttgagctcaggagttcaagaccagcttgggcaacacagagagaccccatctctacaaaaaatttaaaaattagccaggtgtggtggcgtgtgcctgtagtcccagctactcagagagatgaggtgggagggtcacttgagtctggtaggtagggagaggttgcagggagatagtgtcaacgcagcatgtaaaacagaacaagatcctgtctcaaaaaacaaaaacaaaggccgggcacaatggcttatgcctgtaatcccagcactttgggaagccgagaggggcagatcacttgagctcaggagtttgagaccagcctggccaatatagtgaaataccatctctactaaaaatataaaacttagctgggcgtggtgacgcacgcctgtagtcccagctactctgaaggcggaggcaaaagaatcacttgaacctgggaggcagaggttgcagtgagccgagattgtgccactgcactccagcccgggtaacagagcgagactccgtctcaaaacaaaaacaaaaacaaaaacaaaaacaaaaagcctaaaaatactgactgggtcttccccaccaggatgtgtataagacagccttccaccttatgacctagctcagactgaagatgaccaggaaattaataagtattggagaattatctgcccataagcccagatgtgggctggatgcagtgcagaaacaaaggaagtacgtttttaaaaacgaatttgagaatgctgtcaaagggtggattggattgcatgcaattttaatcatgtatttatactcaaaaagtaaccctggccagacacagtggctcttacatttagcaaaatacaagcagtatgatggaggtcttacctgattttatttccagttttcatccgaatccactggggaatgggacgattttgcttttgtttcttggccaggaatcgcttaatcctgaaagtcttgtgagaagactgggaagaaaatgcaatcaatttagacaatattagagcctgcccgaatgattcaaagtcaagaactccttcaaaccaacatttgagtgcttaacacataccccagccccaaaatcttctcaatgctaagccatcaagccaagcaagtctctgaccctcacaacttctctgggggcagataccacagtttccatcgttcagataaaataagtggaatccggttaagaaacatgcacaaaatcagagcatcaatgtgcagaaccaggattcaaacccaggtcctttctgctccacagccagaggctacctttcaatttaccctgtggtcccccaaggactcagacgaccacactgggaatggctagggaatctggcttcctgggaagaacacagctttgagtcaaacagaaccacctacctaccatttgcaagtcaacgaatctcagtgctctactttgtaaaacaggggtacgtacttttcaagtgttattgggagggtaattaagacttagggaaagtccctgacattcagaagatctaacctactcaccatttcggtattaatcctaactctatctctactgctaaatttcactggctaaaaaaataaacttttaaatttaaaaataaatgaaatgtcacttttccaaggatgactgtctcaatttctagttgcatcttttggctttcatctaaggccaaccccaatactcccccaaatctacagaataatcttgcaaaattggcacggatgcaggtttaatgcctggccaacctggacgaacatacccttgcataataatgggagccaatacaaagaaggcaaagattacaccccgtcccccatccacagtagcagttgtaaattttgtcaagtaataaattacttgacaagtaataaaataccagtacttatcgcctccatatctagaaatcaacattttacatttcccagtaaagagtgactggttcgctgctgccatttactaagaaggccagaatgacacacaggttcgcaaaacaccccttgttctaggcgcttccacggggtgacgctcaagtctctgaataaacgtcctctaaacaaaagtcctgggatctaaaaatgcggttcgcttctccacgccaagctaaacccttttcgaaaaccagtagcccacaataccctcctgattaccctccacgttgcgcatgccacgggcagcccacagtcaggccacgatttcgggggtggctgccacctcccaccccccgcctccagaacgagttcgctacaagcgaagggaaaccggaatccctgcccgactcggcagcggccgggcaaagaaagagcccccttgaatccgcggccgcagcgcagcccgtccctctccaggttgctcgctggctcactagcttccctccaggccacgaaagacaacagtggccgaactggatattttcttgaaaaagcctttaaaaggctcccgcccctcaacgctccgcgcggcccaggcatttcctggcagcggcctcgggttttgggaagccaccccggggccgatgggggccgatggacttaccatggcgagcagcggagtcaagaacacaccacgatggcggagaaaggaagaggagggaagctggcggaagaacgagcttagaaggcgcttccgatgggcggagtttaggaggtgacgctatgcaccgaccgcctcttctagtgccttctctgtctagcggtgcgctcccgtggcgccgtgggaaagcgcgctggtttctgccaaatgcagttagctttgcttcgcttccctaagtgcgttcccccaggggcccggcagtgtgctaggggcaccctgcttcgtaagtgaggcagacagcccgtgataaatgccaaagtagaagcccctccgaaaaattaaggagccgattgggcgggactaaccctaagggagggcaggggaagcgaccgtcacctccgggcgccggggactcggaacgccgggtcggagctcggcaggcggagagtaagtgccattttcccagagggttacgagtcatttcggcctggctgggaggtgtgggaagggacagtcgtgtcggaggaagccggagaagttggagggggttggaccacgtggacgcttatgtaagcctaggggttttcgactaggcggaaggttgccaatcaaagttttcaactcagaaagttagggacagaacctcttccttggctgctagaagtccagcctgacattgtagcccgcctttggcaagatgtacaataattaataacatgcgtttgggatgctagtgttccccattttcatccttttccccatttaaaagcaaaaacctttcctttttgatgagtaaataaaataaacataaaaataagctgggcgtggtggctcacgcttgtaatcccagcactttgggaggcctaggcgggcggattacttgaaacgaggagttcgagaccagcctggccaacatggtgaaaccccgtccctactaaaaatacaaaaaaactaaccaggcgtggtggcgggcgcctgtaatctcagctactgcgggggctgagacaagagaatctcttgaaccctgaaggcggaggttgcagcgagccgagattgcgccactgcactccagcctgggcaacaagagcaaaactccatctcaaaaaagaaaaagtaaataaataaacgcaaaaacctccatgtatatttgcagtcacctcaagcatttttacaccaacggattacagcaagggtttttaacctggagtccacaagagtccatgtatagaattcagaggatcccatgaacttgaatgggaaaatacaactttattttcaccaaatttaatgaaatgtaatgctttctttatttaggaatgtaggcaacagaccacagtggcattagcagtactcgtgacttggtcactaatagaaaccatagatggcttcatgttacattacagttgatgcagatgtctccatatattatttacacactccctttaaattacattagttataagttcacaaatagaactatgttaagaagcccatgtattactatagcacatatttcctttttttttttttcaagactgagtctccctttattgcccaggctagagtgcaatggcacaatcttggctcactgcaacctccgcctcccgggttcaagtgattctcatgcctcagcctcccgagtagctgggactacaggcacgcactaccacacccagctaatttttgtatttttagtagagacggagt[132 bp omitted]attagagcttcaacacatgaattttgggggaacataatttagctcatgacaccaccagtcaccttctaaggccgaattcaaatgctgtctcttccccttagctggaaatcatcaccccttcaacactgttgtaatagtttatttgtacctttcttatggctcctagcactatctgttctgttgcaatgcaaaaggatgaaagtaacagtggctgctgcttatggggcttgatagttactatgtagctgcatgtattaattcaagcctcactgtgagcttaccatgttttaccagtgaccttttgaatcttcaccagaacactacaaggtaagtatggttaatcatcctcattttacagaagagggaactgcaacagggacagattaagttgtatacccaaggtcacacagctactatgttgcacagccggtactcagactcaggtagtccaggcttcagagtctgtgctgtcaccactaccctctactgccttttcaacacagattttgggaacctactctgtctggttcgggtcttcgtgttgggggtacagaagcaaacaaatctgaccaaaaatccctgccctcttggagtcttgtggcgatggtatggttctggatttttttgtggtgggaattacacaaagctacacgtgtgatagaatttgccaagtgtggtgactcacgtctgtaatcccagcactttgggaggctgaggcgggcggatcacctgaggtcaggagttcgagatcaacctgaccaacatggtgaaaccccgtccctactaaaaatacaaaaattagccaagtgtggtggcgcgcgcctgtaatcccagctactcaggaggctgaggcaggagaatggcttgaacccgggaggtggaggctgcagtgagccgagatcgcgccactgcactccagcctgggtgacagagcgagactctgtctcaaaacaaacaaaaaaaattagccgggcatgctggtgcgtgcctgtagtccaagctactcaggaggctgagacagagagaattgcttgaacccaggaggtggagggtgcagtgagccgagatcacaacactgcaccccagcctgggtgacagagtgagactctgtctcaaaaaacaaaaacaaaaaaacaaaaaaaacaattctatacaactcccccctgcccacccctgccccaaggggcatatgtataactggtgaaatctgaataagctctgtggactgtgccaacgtgaatttcctggttgtgatattgtactatagttatgcaagatgctaacactggggaaaactagataaagggtacacagggcctctcagtccctttctttgcaacttcttgcgaatctattgttatttcaaaatacaagtctaaaaaaactctgccttcattgagtttaattatagtggggagttagacaacaaatatgtaaattacatggcacatcagaaggaggtgtcatcaagaaaagcaaagcaggggccaggtgcagtggctaacacctgtaatcccagcattttggaaggctggggaaggaggaatagttgagaccaggagttttagatcagcctggacaacatagtgagactctctacaaaaaatacaaaatttagccactggatgtggtggcacgtgcccgtagctccagctacttggaaggcgagaagggaggagcgcttgagcccaggagttcgaggctgcagtgagccatgattgtgccactgcactccagcctgagcaacagagtgagaccct[150 bp omitted]caaaaaattagccgggtgtggtggtggcgcctgtaatcccagctactcgggaggctgaggcaggagaatcgcttgaacccgggaggtggaggttgcagtgagtggagatcatgccactgtacttcagcctggtgacagagggagactccgtctcaaaaaaaaaaaaaaaaaaattgagaaagggtggcatgaaaggtagaaggaaaaccagcaagaagtgctctttctaaaagcagtaagaattaaaaggataattgacataagcacttaaaagcttatttgctgctgcttctggtcaccagaaagaaaatgcttgctcttaaataaatgagcaataaaaatccaaaaaatccaagttaaaaaatgtatatttggaaaaatggccgggcgtggtggctcccacctgtaatcccagcactttgggaggctgaggcgggtggatcaacttagatcaggagttcgagaccagcctggccaacatggcagaaccctgtctctactaaaaatacaaaaattagccgggaatggtggcacacctgcaatcacagctattcaggaggctgaggcaggagaattgcttgaacctaggaggtggaagtttcagtgagccgagatcgcaccattgcacttcagcctgggcaacagagtgagaccctgtctcaaaaaaaaaaaaaaagttggaaaaaaataatgcagcaataaaaaataatacaaatatagacaggtgtggcagcatgcacctgtagtcctagctacttgggaggctgcggtaggcagattgcttgatcccaggagttcaagtccagcctgggcaatgtagtgagaccctatctctaaaaataaatacaaatgaaaaacaatacagtataataattatttacatagcatttacactacattaggtattataagtaaacaagagatgacttaaagtatacaggaggatgtgtgtaggttatatgcaaatattacataattttatataaaggacttggacatcagtgggttttggtattaaagagatcctggaaccaatccttcatggatactgagagacgattatatctgcaaaggtgtagatgctaagaacaggtatccagggcctcccagagccagcctaggagtctgagctttatcc[131 bp omitted]ctggttcaagcaattctcctgcctcagcctcccaagtggctgggattacagacacatgctaccatccccagctaatttttgtatttttagtagagatgggtttcaccatg[137 bp omitted]aaagccattttatatagaaactcaccattgactcttctctgttacacccttaatccagtctcagcaaatcctgtcagctgtctcaaaaatgtttctcgaattcagtgctcatttcccccaccgtcgttcatctctcacttggattactgcaaaatccttcaaactcttcccccttcttctggccctgcccctctacagtttcttctcaacacagcagtcaatgaccctgttaaaacctaagcctgatcatgtcactgtatttagtggctcctttttatttttcatttttttgagactaagtcttgctctgtcacccaggctggagcgcagtggcatgatctcaggtcactgcaacctccacctcctgagttcaagtgattcctgtgcctcagcctctcaaatggctgggactacaggcacatgccaccacacccggctaatttttgtgtttttaatagagatgggggtgtatgttggccatgttggtcttgaactcctgagctcaagggatctgcccccttctgcctcccaaagtgctgggattgcaggcatgagccactgtgcctggcctatttagtggttcttaatggctcatttcactccagtaaatatctaagtgccccagcctgggcgacatagggagaccctgtcgctacgaaacgttaaaaaattagccggatgtcggggcacacacctgtggtctcagctattcaggaggctgaggtgggaggattgcttgagcccggaaggtcaaggctgcagtaagatgagatcacaccactgtactccagcctgagtaacagagcaagactctatctccaaaaaaaatataaaaagaagaaaaaaattaaagattcaagttctcacaacaggcatacgcttccacatcagccccttccacctcacctctgtgaccttatctcccactgctctcaccatcagttcactgggctttggccatactgggcagttctcagctcagggcctttgcacttgctcttctcgctacctggaagctcttcccctagatgtccccacgccttcatggcttccttcatcagtctccttaggtcttttttccaatgtcacctcagtgagg[135 bp omitted]tggtgaaaccccatctctactgaaaatacaaaaaattagctgggcatgatagtgtgtgcctgtaatcccagctactcaggaggcttagacaggagaattgcttgaaccgggactcgggaggtggaggttacagtgagctgagatcatgccactccactccagcctgggagacagagggacactctgtctcaaaaataaaataaagtaaaataaaataaaataaagtaaaattgcaaaccccaggtcgggcgcagtggctcacacctataatcccagcattttgggaggtcaaggcccagcattctgggcttgagcccagaagtttgagaccatcctgggcaacatggtgagacctccgcctctacaagaaaaatgcaaagattagctgggtgtggtggcacatgcctgtagtcccagctactcaggaagctgaggtgggaggctcacctgagcctggggagttcgaggctacagtcagcagtgattgagccactgcactccagcctgggtgacagagtgagactctctctaaaaaaaatttgcaacccctggcccccactcagcactccctacccctactactgctttatttttctccatattacttacctgagataacatatattttatttattgtttgactccctgcctagaatgtaagctccatgaggtcatggattgtgtattttgttcactgctgtattccctgagcctggaacagtgcctgacacatagtagatgcgcagtaaatatttggtgaatgaatgaacaaacgctaatacatcaaagagacaacatcaaagaacagactccacagggcagtttacatcttcattgtttggcccgacccttcttgtttgagggtggattttcaaaattactgctgaaggcaattgggagccttgaaagcttttaaagggtaagagtaagtggcaattatatatttgttgttgttgatgttgttgtttttggaggcagggtcttgctctatcaccccggctggagtgcagtggtatattctcagctccctgcaacccccacttccccggctcaagccatcctccaacctcaggcccctaagtagctgggactacaggtgcgtgctgccaacccaattttttgtattttggtagagacggggtc[132 bp omitted]ggccagctggagagtagatggggatggggacaatagtggaaacaagaaggctcgtgggggcggttgttaaaattatgcttttttttttttgaaacagagtctcgctcttgtcgcctaggctggagtgcagtggcacgatctcggctcactgtaacctccgcctcccaggttcaagcagttctcctgcctcagcctctggagtagctgggattacagacacctaccaccatgcccgctaatttttgtatttttagtagagacggggtttcgccatgttggccaggctggtctccaactcctgacctcaggtgatctgcccgcctcagcctcccaaagtgctgggattacaggcatgagccaccacgcctggtcagcaaactttttctgatagtaaatattttaggctttgcagatgacatacagtgtctgttgcgactactcaactctgctgttgcaggatgaaagctgcaggacaatatgtaaatgaacggtgtggctgggttccaagaaaactttagttacagatactaaaatttaaattcaatagaattgtcatgtgtcccaaaatattcttttgatttttttcaaccattcaaaaatacagaaaccattcttagctctcaggctgtacaaaaacacgcagtggccaggtttggtccataggctgtaatttgctgagcctaggcctagataattatgtcaagactctcctctccctcctcaaacctgcaacccttcttcctccattctcacactcagttgaggacctggcttcctagtcactgagaaaatttaagcaatcacaagagaactcccacagcccatccacacatgctatctgccaacacctccacgtgactattcccccatccctctgttactgtgaatgaaacgtttgaactatgtccggcctgtctgctcgcttgtgccctagatccaaacctctctcgcccattcaacaaccctgctctgactagtcttccctttctgtccttgctgttcactgcattattcccatcaacatacaaataaatatgctgtcatcttaaaaaagctgctttttactccaactcccttgccagctacttcttcttctccttccctttacaacaaaaccctggtaaagatttgtcttcattcactgtttccaacttctctcccattctttaagtgagatacaattcacgtaatatgaaaatcaccgtttttttattttattttatttttgagacagagtcttgctctgtcaggctggagtgcaatggcgtgatctcagctcactgcaacctcggcctcccgagttcaagcgattctcctgccccaacctcccaagtagctgggattacaggcatgcaccaccacacccagctaatttttgtatttttagtagaggcagggtttcaccatgttggccacgctggtcttgaactcctgacctcaggtgatctgcccacctcggcctcccagagtgctgggattacaggtgtcagccaccgcaccggccactattttattttattttatttatttttgagatagagtctctgtcacccaggctggagtgcagtggcatgaactcagctcactgcaacctccgcctcctgggttctagtgattctcctacctcagcctcccaagtagctgggattacaggcatgtgccaccacgcctggctaattttgtatttttagtggagatggggttttgccatgttggcccagctggtcttgaactcttgacctcaggtgatccacccgcctcagcctcccaaagtgctaggattacagatgtgagccaccgtgcctggcctagcagtcactctttcattcccactcttctctcagccctaggaaaccactaatctattttccgtctctgtggatttgcctattctggatattttatataaatggagacacaatatgtagccttttgtgtctgctttctttcacttagcataatgttttcaaggttcatccatgttgtagcatgaatcagtatttcattttttttagaagtggggtctcactatattgcccaggctggtcttgaactcctgagctcaagcaatcatcccaccttggcctcccaaagtgctagaattacaggtgtgaggcactgtgccaggccaacattttttattttttttaatagagacagggtctcactatgttgcccaggctagtctcgaactcctaagttcaagtgatgctcccacctcagcctcccaaatgctaggattacctggaagagctctcatgcccggctcatttttctttctctttctctttctttttttttctttctttctttcctttctcctttttttctttctttccttccttctttccttctttcctttccttccttctttccttccttcctccctccctcttctctctccctcctttccttccttttttccttccttccttctttcattcctccctccctccctctctccttccctctttccttcctccttccctccctctcactcttttccttgcttccttttctttctctttttctttttctttctctctctttctctttccctccctccctccttctctttccctccctccctccttctttcttttttctttctccttccttctttccttatttccttttccttccttccttcttctctttcccttcctttctccctccctcccttttctttctcttttctttccttcctttctctttctccttccttcctcctcctttttctctttctccctttctctccttccttccttctttccttttttccttccttcctttcttccctccctccctccctcccttttctttctttcccttcctccctccctccctttctttcctcttttctttctttttccttccttccttcctttccatttttttcctccttcctttctttcttcttgacagagtcttgctctcttgcccaggctggagtgcactggtgtgatcttggctcactgcaacctctgcctcctgggttcaagcaattctcctgacacagcctcctgagtagctgggaccacaggcttgtgccaacacgcctggctgacttttgtatttttaatattttttctttttttttttttttggtgtttatttttttgagacagagtctcagtctgtcacccaggcagcagtgcagtggcgcgatcttggctcactgcaacctccatctctcaggttcaagcaattctcctgcctcagcctcccaagtagcttggattgcagatgtgcactaccacgcccggctaatttttgtatttttagtaggggtggggtttcaccatgttggccaagctggtcttgaagtcctgacctcaagtgatcctcccgcctcggcctcccgaagtgctggcatttcaagcatgagccaccacgcccagccgtatttttagtggccaaccttgctggccactcctcctccttgaaacacttttctcttggattaagtaacaccggagtcttctggtatttctcctactctggctattctttctgtctttgtagatacatttccttacctctgtgtaatgttaagagttctttaaggctgggccctaggtctgcttctgttcctacttcactctctccccataaagtgacagaatccatggtcatgacttcaatggacccctaaaaatggatgaattccaaatccatacatccatttcccacctgccattcacccctcactataacatggtttctatctcttttaggtcatcagtttcattagttcactaatgaaatcacgactgccaaatccaatgaacacttccatttcttgtcttccttaatctctctgtggcatgggacaatgtcagccaatctccttcttgaaattttcccttcccttaatcctctcgcccatctgacagtcattcactttcaatcatttttggtggctcttgtacctccctcttgggctacttgtttctaaaagctgaggaaacaaagttatttagaaagtaaaggcaaagtgatgccatgttaggaagggctggcagaatgaatgaaaatcaggcaaaagctcaaggatgttgtctaaacattttgttcttaagggaccagaatagttgatgtggtttggatatttgtccccacccaaatctcatggaaatataatccccagtgttgtaggtggggcctggtggggtgttggggttatggggcagatccctcatggcttggtgctgtcctctccatagtgagttttacagagctggttgttgtaaagtgtggcacctcctccccgcactcactctcttgctcactctgtgatgtgggatgtcttctgcttcactttccaccatgagtaaaagctccctgaggctttcccaaaactcgagcagataccagtgccacacttcctgtacagcctgcagaactgggagccaattaaatctcttttcttataaattatccagtctcaggtatttatttatttatttatttatttatttttctgaggcagagtctcattctgttgcccaggctggagtgcagtggtgtgatctcggctcattgcagcctccaccttcctgggttcaagtgattctcctgcctcagcctcctgagcagctgggattacaggcacctgccaccatgcctggctaatttttgtatttttagtagagatggggtttcatcattttggccaggctggtctcaaactcctgacctcaagtgatccgcccatctcagccttccaaagtgttgggattacaggcgggagccactgcacctggccaggtattttttttttttctttttttgagatggagtctcactctgtcacccagactggagtacagtggcacaatctcggctcactgcaacctccacctccctggttcaagtgattcttctgcctccgccttctgagtagctggggactacaggcgtgtgccaccacgcccagctaattttttgtatttttagtagagatgtggtttcaccatgttggccaggctggtctcaaactcctaacctcgtgatccacccacctcagcctcccaaaatgctgggattacaggcatatgccactgcccccagccccggccaggtatttctttataataatgtaagaacagcctgtattagttcg[133 bp omitted]aattcccatctctactaaaaatacgaaatttagccaggcacggtggcggatggctgtaatctcagctactagggaggctgaggcaggagaattgcttgaatctgggaggtggaggtttcagt[131 bp omitted]cacatgggtagggaggccccacaattatggcagaaggcaaggaggagcaagtcatgtcttacatggatggcagcaggacaaaaagagcttgtgccggggaactcctctttatgaaaccatcagatcttgtgagacttcttcactatcatgggaacagcacaggaaagacctgccccattattcaattacctctcactgggtccctcacacaacatgtaggaattcaagatgagatgtgggtgggggcacagccaaaaaacatcaggcctaatataggagtgaaccatgaactgatttttccctggtagacaaaacaaaggcatgccagtgaaagcagaaactaatatcattcatgcacttttgaaattctccagaggttaattcagtatcaaaaatttaatttctcaaatataacagctatttagtgaagttaataaacacacttagcttcatacttgaatgttgttactatttattgacatcaaaacaaaacaagctgagactaaaagttgctatttaacaggaacagacattgatgcagtttccttcctggagagggtacacactcagatcatgagacctaagataaaacacacactggattgtcaagaatcaaacaaggactaccaatgggatctaattaaactaaagagcttctgcacagcaaaagaaactaccatcagggtgaacaggcaacctacaaaatgggagaaaattttcgcaacctactcatctgacgaagggctaatatccagaatctacaatgacctcaaataaatttacaagaaaaaacaaccccatcaaaaagtgggctaaggacatgaacagacacttctcaaaagaagacatttatgcagccaaaaaacacatgaaaaaatgctcatcatccctggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaaaaaagctgaagataaaagcagatgtttgaaaatattcttcatgctaagctcatgtaagcaaacaaaaaactaaaagtaatccttaaactttaggacattagatgcagaagtaacatgactatttaaattttggcaccaacaaaagtttgttctatccttcactgtacttatactacaaggacatgcttgttgcttctacacttcccaaagtcaacagttatcatcaacaatgcaataaaactagattggaatggacgggcacggtggctcatacctgtaatcccagcactttggaaggccgaagcggggggaatcacctgaggtcaggagttcaagaccagcgtggccaacgtggtgaaaccccatgtctactaaaaatacaaaaattagccaggcaaggtggcgggcacctgtaatcccagctactcgggaggctgaggcaggagaatcagttgaacccaggaggtggaggttgcagtgaaccgacattgagccactgtactccaggctgggcaacagggtgagaccctgtctaaaaaaaaaaaaaaaaaaaaaaaagaaaaaaaaaaaagaaaattcaactcgggatgaacaacagcttttgattttagaaccagctcttacttttctctcgtgtcatacgtaatgaagtcctcacttgacatttccctgcaaattgcaatgcatgtcctcaccatcagctttttctgacactaaaattaatttgtataaattgcaaaagcaatgaaattgtacttccaattctgaacctctgatcagattcctgctttgacacaagacttactcctctgcagtgtaccccaccagcacaaccaccccctttctctctattctttgccctgaaggcacttctggattgcttaacgtgtgctctttggctgcctagacagtcagtacacctaaggccatctggacttaacactcccttcctccttcttttctatggttaatatcactttcctgctttctttctactgctgaatctccagattggtgctgccatcttgccaccagaatcgacctgggcttcgagctcctggatggtaaagcttcatccctggatgatcctgaagtataatgaaatatgttactgttagaacaatgctaatatgctttaaatgggattatcaggtcatatcttatatatattaatatatactaaagctcagtaatttaagaccaaaaatgtgagggcatggtaaatgacaacttgcccatttcctctctccatctccaaagaaaagcaaccattttataattattattttataagcctggttcagtttcttttttttcagagatatcatctcactgtgtcacccaggctgaagtgcaagtggcacaattgcagctcactgcagcctcgacattccagactcaagcgatcctcccacctcagctccctagtagctgggattgcaggcaggtgcaaccacactgggctaagtttttaaatttttagtagagagggggtctccctatgttatccaggcgggtcttgaactcctgaagttaagtgatcctcccgccttggcctccgaaatgctaggagacggggtttcgccatgtaggcccagctcgtctccaactgctgacctcaagttatctgcctgcctcagcctcccaaagtgctgggcttatagggatgagccaccgtgcctggcctatagttattaaggacatgaaattatgctttatgaggaagtggtcctcacccccactgcctacaacacaagaaaggagaggaagggagcaaactagaagaagaaaggtggtattgggggaaaggatatcaattaaagatggattttaaaaattgcttcgcaggagggagggccctcctgtggtttcactggttgatctggctgagggattttctccagcgacacttgcagcttaggggcaagaggctcccacaacaccctgtgctacctcgacccttctgacattgtgcatcatgatctgattattgctatttgcctcttgccaatattgaaccatgagttcaacacagacaaggacttattttaatccttgaccccagggccgggcacacagtcagtgattggtacatgtttgctaaatgaatgagcaaatggaagaaattgaagagggtggggtggggacgtgtggtttatccagagctggacaggcaaggcaagtagaacagaagagggaggtgctgacgtgaaaacggccttgagatggctggcaacaggctagacaaagaggcaagggatgtcagctcatgcctggtggttcaggagaatggcttctcttaaggccaactcctctaacctctatcttggcttccattttcacctgcctttgcaggaagcctacagtattagtagtctctttctcttgggtattcattcttttagagctttccttttggcttctaaacttactttctcatatttaaaataatgcttcattaacaccattaacctatgtatctcaatttctttcacagctgtgttagtctgttttcacagtggtagaaagaaatacccgagactgggtagtatataaagagaagagatttaattgactcacagtttcgaatggctcgggaggcctcaggaaatttaaaattatggcagaaggtgaagcaggcatgccttacatgacagcaggcgagaggtgaattgcgagtataggaaaaactgccacttttaagaccatcagatctggtgtgactcactcattatcaggagaacagcatgagggaaaccagcctcctaatccaatcacctcccaccaacttcctcccttgacacataaggattacaattcaagataagatttgggtggggacacagagcccaaccatatcaacagccatatgagaagtcttcaaaaagtccatggaaaatgtgtattatcaagaaactgtgcatggattgcaaaatctttttgagggctgggcatggtgactcacccctgtaatcccagcactttgggaagctgagactggtggatcacttgaggtcaggagtttgataccagcctggccaacatggtgaaacctcgtctctactaaaaaacagaaaaattagccaggtgtggtggttcacacttgtattctcagctactcaggaggctgagggaggagaatagcttgaactggggaggtgaggttgcaatgagctgagatcgcgccacagcactgcagcctgggcgacagagtgagactccatctcaaaaacaaaatctttttgcaccaaaacaaactggtactaacgcattataaaatgtctcaacaggatctagtttgagtcattaaaaaggagaagtcatcagtttgaaaagagctacaatcagagcaaaatgaattctgctaaaattgaaggaacaacaaacgtcaaatttagggtgaggttagggtggaagaatggtaaaatcactgatgctttaccaaaagtttatggggacaatgcacctaaataaatcagcagtttataaaaatagttaatttgtaagaaaggacaagacgatgctgaagatgaagcctgcagcagcaggtcatccacatcaatttgtgagaaaaaaaatttatcttctttgtgccctaatttggaaggaccaacgattaacagcagaaacaacagtcaacaccatagacatcacaattggttcagcttacagaattctgactgaaaaatcaaaagttgagcaaactttccacttgatgggtgccaaaaccagatcagctgcaaagaacagagctttcaatggaaattttaaacaagtaggctctattggttgctacaaaattaattgcagtttttgccattgaaagacatgtcaaaaaccgcaattacttttgccccaaccaatagatcatgaagcatctattgggaaagtgtaacaggaggtgaaatgtggctttccaactatggagacaaagtacaatcgaagtaatggctccgaagatgtggaagtggtccagtcaaagcaaaagtggtctggtcaagagcaaaggtcatggaaatagttttttgagctgcttgagaaattttgcttgttgactttctggagggccaaagaaaaataacatctgcttattatgagagtgttttgagaaagccaaagctttagcagaaaaatgcccaggaaaacttcaccagagagtccttttctatcacagcaaaggttctgctcacgcctctcatcaaacgggaaattttgagagagtttcaatgggaaaccagtaggcattcaccctacagttggtatttagctccttccaacttcttttggtttcctaatgataaaaaatctgtaaagggtaccattttttttccagttaataatgtaaaaaagattgcattgatgtaaattcccaggaactccaattctttggggatggataaaatggctagtatctaagtgctgtgagcaagagacaaaaataaataaataaatggctaatatcattgcctacaaaagtgtcaaagtttcttgaccttggtggatcttataagtttatattttttatcttttacgtctattttccacaaacttttttttttttttgagacagagtctggctctgtcacccaggctggagtgcagtgacgtgatctccgctcactgcaacctccgcctcccgggttcaagcgattctcctgcctgagcctcctgagtagtttgtactacaggtacgcgacacaacacacagcaatttttttttctatttttttagtagaggtggggttttgccgtgttggccaggctggtcttgaactcctgacctcaggtggtccacctgcttcggcctcccaaaatgctgggattacaggagtgagttactgc[211 bp omitted]gaggcaggagaatcacttgaaccccggaggcagaggttgcagtgggcaaagatcgtgctgctgcactccagtctggtgacagagtgagactcagtctcaaaaaaaaaaaaaaaaaatccctcaggctggacacggtggctcatacctgtaatcccagcactttgcgaggctaaggtgggcggattgcttgagcccaagagtttgagatcagcctgggcaacatgggaaaaccctgtcttgacaaaaaatacaaaagttagctgggcatggtggcctatgcctatattcccagctactcaggaggctgatgtgggaggatcaactgaacccagaaggtcaaggctgcagtgagccgtgattgtgccatggcactccagtggtggtgacagacagaaaccttacctcaaaagaaaaaaaaaaatccaggctgggcccagtggctcatgcctgtaatctcagcccattgggaggtttaggtgtgcacatcacttgaggtgaggaattggagaccagcctggccaacatggtgaaaccctgtctctacaaaaaatacaaaaattagccatgtgtggtgccaggcatctgcaatccagctacttgggaggcagaggaaggagaatttcttcaactcaggaggtggaggttgcagtgagccaagatggcaccactgcactacagcctgggtgacagagcaagactctgtcttaaaaaaaaaagaaaaaaatccacctaggaactaattgcaagccatgattctttctgataattacatatttatatgttcaggagaatgtgaaggaggcctcagagtagaactaagggtccagaaacttttgaagatccctcgtacttccctaaaaagttgtatatatcttttccattctcaacccaatctggcttccctgccccataattctagggcatcagtgatttgcaagtcactgaatgccatggcttttgtcaggcatcataattgaccattcagcggcatccaaccctgctggccactcctcttccttgaaacacttttctcttagattaagtaacccagagtcttctggtttttctcctactctctggctagtccttctctgtttttgtagatacatttctttacctctatgtaatgttagtttttcgaggttgggccctaggtctgcttctgttcttacttcactctccctcttaagtaacagaatcaatggccatgacttcaatgaccacctaaaaagagatgaattccaaacatacatccatttcccacctgccattcacccctcactgtaacatggtttctgtctcttttaggtcatcagtttcattagttcactaatgaaatcacgactgccaaatccagtgaacacttccatttcttgtcttccttagcctctctgtggcacgggacattgtcagccaatctccttctagaaattttcccttcctttagtactcttgcccagttgacaatcatttactttcagtcattattggtggctcttgtacctgcctctttggctatttgtttctaaaagctgggaaaacataaagtggtgattaagaaagtaaaggcgaactgatgccacgtcaggaagggctggcagaatgaatgaaaatcaggcaaaagctcaaggatgttgtctaacattttgttcttatgggacaagaatagtggatgtagtttggatatttgtccccacccaaatctcatggaaatataatccccagtgttgtaggtgggtcctggtggggtgttggggttatggggcggatccctcatggcttggtgctgtcctctccatagtgagttcttacagagctggttgttgtaaagtgtggcacctcctccccgcactcactctcttgctcactctgtgatgtgagatggctgctcctgctttaccttccgctatgagtaaaagctccctgaggcctcccagaagctgagcaatgtgagattcccgacttgtacagcctgcagaactataagccaattaaacctcttttatttttttcttttctttttttttttttttgagatggagtctcgctctgtcacccaggctggagtgcagtggtgctatcttggctcactgcaacttctgcctcctgggttcaagcgattctcctgcctcggcctcccgagtagcttggattacaggagcgtgccaccatgcccggttaatttttttgtatttttagtagagacagggtttcaccatgttggccaggctggtctcaaactcctgacatcaagtggtcatcccacctcagcctcacaaagtgctgggattacaggcatgagccaccgtgcctggccaaacttcttttcttatcaattacccagtctcaggtgtttctttttagcagtgcaagaatggtctaatacaggagtgaaccatgaactgatcgttctctggtggacaaaacaaaggcatgctagcgaaggcagaaactaatatcattcatctgctttccaaactccaaagaggttaattcagtatcaaaaaattaatttctcaaaattcacagctgtttgctaaagttactcactacacttaacttcatacttgaatgctgttactatttattgacatcaaaacaaaacaagctgagactaaaagttgctatttaacaggaatagacatcggtgcagtttccttcctggagagggtaggcactcagatcatgagacctaagatcaaacaaactagattgtcaagaatccaacaaggactacattttacctcttaataaaaaaaatgctggagacaaaacaagatgtttaaaaatattcttcatgccaagcttagataagcaaataaaaaactaaaactaatcctaaaacttgaggatattggatacggaagtaacatgactatttaaatgtttgcatcaatgaaagtttgttctattcttccctgtacttgtactacaaggacatgcttgttgcttctatactacccaaagtcaacagttatcatcaacaattcagtagaaatagatcagaacaagacttcaaagcgactctgctccaccaaaatttagaaactcaatttgggatgaacaaaagcttttgattttagaaccagctcttacttttctctcatgtcatatgtgatgaagtcctcacttgacatttccccctgcaaattgcaatgcatgtccttgccatcatctttttctgacactttaatttatagaaattgcaaaagcaatgaaattgtacttccaattctgaacctctgatcagattcctgctttgaggcaaaacttactcctctgctgcacactcctctactcttttctttctttcttttttttttttttttttttttttgagatggagtcttactctgttgcccaggctggagtgcagtggcaagatcacggcttactgcaacctccgcctcctgagttcaagcgattctcctgcctcagcctcccgagtacctgggactacaggcacctggcaccacgcctggctagttcttgtattttcagtagagatggggtttcaccatgttgaccaggctggtctcaaactcctgacctcaggtaatccacccgcctcggcctcccaaggtgctgggattacaggcgtgaaccatcacacccagcctctcctcttcttttgtatggctaatacaactttcctgctttctttctactgctgaatctccagacttggttatgtcatcagggtgcgagagtcgaccttggcttcgagctcctggatggtaacgctgcatccctggatgattctgaagtacaatgaaatatgttactgttacaacaatgctgctaagcttttacgtgggattttcaagtcataacttatatattaatatatactaaagtccagtcatttaagaccaaaaatgtgaaggcatggtaaatgacaacttgcccacttcctctctccatttccaaagaaaagcaaccatttcctaattattattttataagcctggtacaacttatttttcttagagacatggtctcattttgtcactcaggctgaagtgcaaatggcaagattgcagctcacaacagccttgacattccagactccagccatcctcccacctcagcttcctagtagctggaattgcaggcacgctctaccacactgggctaagttttaaaatttttaatagagatggggtctccctatgttatccgggctggctttgaactcctgaagttaaatgattctgccaccttggcctcccaaatgctaggattgcctgcatagacgaagtttcgctctggttgtccaggttggagtgcagtagtgcaatctcggctcactgtaacctctgcctcccgggttcaagcgattctcctgcctt[213 bp omitted]tatgaggaagtggtcctcaccccccttgcctgcaacacaagaaaggagagcaagggagcaaagtagaagaaaggtggcactggggaaaggatatcaattcaagactgatggtaaaaattgcttagcaggagtgaaggctctcctgtggtttcaccaattgatctgcttgagggattttctccagcgacacttgcagcttaggggcaagaggctcccacaacaccctgtgctaccgcgacccttctgacattgtgcatcatgatctgattattgctatttgcctcttgccaacactgaaacatgagttccacgtgcacaaggacttatttgaatccctgaccccagggcctggcacacagtcagtgattggtacatgtttgctaaatgaatgagcaaatggaagaaattgaagagggtggggtggggatgggtgatttatccagagctggacaggccaggcaagtagaacagaagagggaggtgctgacatgaaaacaggctagacaaagaggcaaggatgtcaactcatgcctgggggttcaggagtgttgcttctcctaaggccaactcctctaacctctaccttggcttccattttcacctgcctttgcaggaagcctacagtattcgttgtctctttctcttgagtattcatccttgtagagcttaccttttggcttctaaacttacttactttctcatatttaaaataaagcttcattaacaccattaacctatgtatctccatttctttcacagctatattaattggttttcacactagtagaaaaaatacccaaggctgggtaatatataaagagaagaggtttaattattttattttatttttatttatttataaaataaataaaatatgtgacgtagtctcgctcttgtcgcccaggctggagtgcaatggtgcgatctcggctgaccacacttctgcccttcaggtttaggcgcttctcctgcctcagcctcctgagtagctagaattacaggcgggcataagcacacccagctaatttttgtatttttagtagagatgggtttcgccatgtttgcctggctggtctggaactcctgacctcaggtgatccaccggccttggtatcccaaagctgggattacaggggtgagccaccaagcccagccgaagaggtttaattgactcacagttccacatggctgggggagcctcaggaaacttacaatcatggcagaaggggaagtggacacatgctacatggcagcagactagaggtgaagtgcgagcataggaaaaactgccttgtttaaaaccatcagatcttgtgaggcttactcactatcacaagatcagcatgtgtgagactgccccaataatccaatcacctcctaccaagctcctcccttgacacatgaggattacagtttaagatgagatttgggtgcgggaacagagctcaatcatatcaacagtcatatgagaagtcttcaaaaagtccatggaaaatgtgtattatcaagaaactatgcatggattgcaaaatcttttggcatcaaaataaactggtactaactcgttaaaaaatatctcgacaggatctagtttgaggcattaaaaaggagaaagcatcagtgtgaaaagagctcctatcagcgaaaaatggattctgctaaaattgaaggaagaacaaacataaaatttaagatgaagcttgggtggaagaacggtaaaatcactgatgctttaccaaaagtttatggggacaatgcccctaaagagatcagcagtttacaaatggataacttgtaagaaaggacaaaatgatgttgaagatgaagcctgcagcagcaggtca[210 bp omitted]gaggcaggagaatcgcttgaacccaggaggcggaggttgtggtgagctgagatcatgccactgcactccaacctgggcaacagaatgagactccgtcttaaaaaacaacaacaacaaaaatcctcttcgtgctttaactgaaaagcatcggctgggtgtggtggctcacccctgtaattccagcactctgggaggccaaggcgggcgggtcatctgaccaacctggcccacgtggtgaaaccctgtctctaataaaaatacaaaaattaactgggtgcggtggcaggtgtctgtaattccaactacttgggaggctgaggcaggagaatcattgaacccgggaggcagaggttgcagtgagccaagattgtgccactggcctccagccttcgtgagagactaagaccaactattaatggcagaaacaacagccatcaccatagacatcacaattggttcagcttacacaattctgactgaaaaattaaaagttgagcaaactttccacttgatgggtgccaaaaccagatcagctgcagacaagaacagagatttcaacggaaattttaaacaagtgagatctattacgttgctgcatattaattgtggtttatgccatggaatgtcaaaagccgcaattacgttggcaccaaccaatagatcatgaagcatctattgggaaagtgtaacgggaggtgatacgtggctttcccagtatgactctgaagacaaagcaatatcaaagcaatgactctgaagaggtggaagagatccagtcaaagcaaaactggactggccaagagcaaaggtcatggcaatagttttttgagctgcttgagcaactctccttattgactttctggagggccgaagaatagtaacaccagcttttttttttttttttttgagaccaaatctcactctgtcacccaggctggactgcagtggtgcaatctcggctcactgcaacctctgcctcccaggttcaagctgttctcctgcctcagcctcctgagtagctgggattacaggcacgcaccaccacgcctggctaatttttgtatttttagtagaaacgaggtttcaccatgttggtcaggcttgtctcgaactgctgacctcgtgatcctcccatctcggcctcccagagtgctgggattacaggcatgagccaccgtgcccggccaacacctgcttattataagagtgttttgagaaggccaaagctttagcagcaaaatgcccaggaaagcttcaccagagagtccttttctaccacggtaatgcttctgctcgtgcctctcatcaaacaagggcaattttgagagtttcaatgggaaaccattaggcatccaccttacagtcgggatttagcttcttctgtcacttttttgtttcctaattttaaaaagtctgtaaagggcaaccatttctcttcagttaataatgtaaaaaagatttcattgatgtggttaaattccaaggacctccacttcttaggggatggatgaaatgactagtatgtaattgttgtgagcaagagacatacatacatacataaatggctagttatcattgcttatgaaagtgtcttgaccttggtggatcttacgatgagaagtttatatttttttcttttatttctattttccacaaacttttcttttctatttttccttttttttttttttttttttgagatggagtctggctctgtcgcccaggcaggagtgcagtggcacgaccttggctcactgcaatctccgcctcttgggttcaaacgattctctagcctcagcctcccgactaactgggattacaggagcccgccactgtgcctggctaatttttgtatttttagtagagactgggtttcaccatgttggccaggtttgtcttgaatccctaacctcaggtgaagtgcccgccttggcctcccaaagtgctgggactacaggcatgtgccacctcaatcccctgcctttttgttgtggggaggatggagtctccctctgtcgctcaggcaggagtgcagtggtgagatctaggctcactacaacctctgcctcccgagttgaagtgattctcctgtctgagcctcctgagaagtttggactacaggtgtgctccaccaagcccggccaaattttttttttgtattttttggtagagatggggttttaccatgttggccaggctggtctcaaactcctgacctcaggtgatccacctacctcagcctcccaaagtgctgggattacaggcatgtgccaccaagcccggcctttttttgggtgtggtggtgaggggggcagatggagtctaactctgttgctcaggcaggagtgcaggattgagatctctgctcactggaacctctgccactcaagttcaagtgattctcctgcctgagcctcccgaggagtttggactacaggtgcgctccaccaagcctggccaatttttttttttttgtattttttggtagagatggagtttcaccatgttggccaggctggtctcgaactcctgacctcaggtgatccaaccgcctcagcctcccaaagtgctgggattacaggcatgagccactgcccctggcttctgttcttttaaaaatccatataaagctggacacggtggctcatgcgtataatcccagcacttttcgaggctacagtggacagattgtttgagcccaggcatctggcaaacagatgccatgttaggaagggctggcaggatgaatgaaaatcaggcaaaagctcaaggatgttgtctaaacattttgttcttatgggaccagaacagttgatgtagttttgaaatttgtccccacccaaatctcatggaaatataatccccagtgttgtaggtggggcctggtggggtattggggttatggggcggatccctcatggcttggtgctgtcctctccatagtgagttcttacagatcaggttgttgtaaagtgtggcacctccttcccacactcactctcttgctcactctgtgatgtgacatgcctgctcctgcttcactttccgccatgagtaaaaggtccctgaggcctcccagaagctgagcaatgtcagatgccatgcttgtacagcctgcagaactgtgaaccagttaaacctcttttcttataaactacccagtctcaggcatttatttatagcaatgcaagaacggcctaatacaggagtgaaccatgaactgatctttctctggtggacaaaacaaaggcaatgcctgtgaaggcagaaactaacattattcatctgcttttgatacttccaagaggct[137 bp omitted]tggtgagacccccatctctactaaaaatacaaaaaattaaccaggcgcggtggcaggtgcctgtagtcccagctactcaggaggctgaggaaggagaataatttgaacccggagggtggaggttgcagtgagccgagattgtgccactgcactccagcctgggtgacagagtgaaactctgtctcaaaaaaaaaacaaaaaaaacaaaaaaaacctcacagctgtttactaaagttactcaccacacttagcttcatacttgactgctgttactatgtattgacatcagaacaaaacaaactgaaactaaaagttgatatgtaacaacaacagacattggtgcagtttccttcctggagagggtaggcaccagatcatgagacctgagataaaacaaactagattgtcaagaatccaacaaggactacattttacctcttaatagaaaaaatgctggagacaaaacgagatgtttaaaaatattcttcatgctaagcttatgtaagcaaataaaaaaacaaaagtaaccctaaaatgttaggacattggatacagaagtaacatgactatttaaatgtttgcatcaatgaaagtttgttctatccttccctgtacttatagacaaggacatgcttgttgcttctacactacccaaagtcaacagttatcattagcaatgcaatagaaatagatgggaataaagcttcaaagcgactctgctccaccaaaatttagaaattcaattcaggatgaacaacagcttttgattttaaaaccagctcttacttttctctcgtgtcacacgtgatgaagtcctcacttgacatttcccctgcaaattgcaatgcatgtcctcgccatcagcattttctgacactttaatttatagaaattgcaaaaacaataaaattgtacttccaattctgaacctccgaccagattccttctttgagacaaaacttactcttctgctgcgtactcctctcctctttatttttttttaatttttttggagatagagcctccctagtgtcacccaggctagagtgcagtggcacgatcatggcttactgcaacctccacctcctgagtttaatcaattctcctgcctcagcctctcgagtacctgggactacaggcgcctgccaccaagcccggctaatttttgtagttttagtagagactgggtttcaccatgttggccaggctggtctcaaagtcctgacctcaggtgatccacccatatcggcctcccaaaatgctgggattacaggcatgagccaccacgcccggcctctcctcttcttttctatggctaataccactttcctgctttctttctactgctgaatctccagacttgtcatcagggtgccagagtcgacctcggcctcgagctcctcgatggtaacactgcatccatggacagtcctgaagtacaatgaaatatgttactgttacaacaatgctactaagcttttacatgagatttttaggttataccttatatattaatatatactaaagcccagtcatttaagaccaaatatatgagggcatggtaaatgacaacttgcccacttcctctctccatctccaaagaaaagcaaccatttcctaattattattttttatgtctggttaaatttattttctttggagacagggtctcactgtgtcagccaggctgcagtgcaagtggcatgatccagcttcgacattccagactgaaggaatcctaccacctcagctccctagtagctgggatcgcaggcccgtgctaccacattgggtttttaaattttagcagagacggggttgccctatgttgcccaggctgttctagaactcctgaagttaaatgatcctcctaccttggcctcccaaatgctagggttacctgcaggagccatcacgcctggcccatttcttttctttttttcctctttttttttttttttttttgtctgagacagagtcttgctctgttgcccagactggagtacagtggtgtgatctcggctcactgcaacttctgcctccccagttcaagcgattctcctgcctcagtctcccaagtagctgggactacaggcatgcgccaccatgcccggctaatttttgtatttttagttgggacagggttttaccatgtttttcaggctgatctcacactcctgacctcaagtgatctgctcgcattgacctcccaaagtgctgggattataggcatgagccaccaacactggccccaggcttgtcttgaactcctggcctcaaagtgatcctcttgccttggcttcccaaagtgctaggattacaagcatgagctatggtgcctggcctatagttattaaggatgtgaaattatgctttatgaggaagtggtcctcacccccactgcctacaacacaagaaaggagaggaagggagcaaactagaagaagaaagatggtattgggggaaaggatatcaattaaagatggattttaaaaattgcttcgcaggagggagggccctcctgtggtttcactggttgatctggctgagggattttctccagcgacacttgcagcttaggggcaagaggctcccacaacaccctgtgctacctcgacccttctgacattgtgcatcatgatctgattattgctatttgcctcttgccaatattgaaccatgagttcaacacagacaaggacttattttaatccttgaccccagggccgggcacacagtcagtgattggtacatgtttgctaaatgaatgagcaaatggaagaaattgaagagggtggggtggggacgtgtggtttatccagagctggacaggcaaggcaagtagaacagaagagggaggtgctgacgtgaaaacggccttgagatggctggcaacaggctagacaaagaggcaagggatgtcaactcatgcctggtggttcaggagaattgcttctcttaaggccaactcctctaacctctaccttggcttccatttacacctgcctttgcaagaagcctacagtatttgttgtctctttctcgtgggtgttcatccttctagagctttccttttggcttctaaacatactttcttatatttaaaataatgcttcattaacaccattaacctatgtatctccatttctttcttttttttttttttttttttgagatggagtcttgctctgtcgcccaggctgaagtgcaatagcatgatctctgctcactgcaaccgccgcctcctgggttccagcaattctcctgcctcagcctctcgagtagctgggactacaggtgtgcaccaccatgcccggctaatttttctatttttggtagagacggggtttcaccatgttggccgttctggtctcaaactcctgacctcaggtgatccaccggccttggcttcccaaagtgctaggattacaggtgtgagtcactgcgcccagccgtatctccatttctttcacagctgtattagtccgttttcacactggtagaaagaaatacccgagtgtgggtaatttataaagaaaagaggtttaattgactcacagttccacatggctgggggagcctcaggaaacttacaatcatggcagaagggaaagcgggcatgtcttacatggcagcagactagaggtgaagtgcgaacataggaaaaactgccttgtataaaaccatcagatcttgtgagacttactatcacaagatcagcatgtgggagactgcccccataatccaagttcctccctagacacatgaggattacaattcaagatgagatttgggtgggtatacacagccaaactatatcaacagccatatcagaagtcttaaaaagtccatggaaattgtgtattatgaaaaactatgcatggatttcaaaatctttttgcaccaaaataaactggtactaattcattataaaatatctcaacaggatctagtttgaggcattaaaaaaggagaagtcatcagtttgaaaagagcccctatcagaacaaaatgaattctgctaaaattgaagcaagaacaaacatcaaatttagggtgaagcttgggtggaagaatggtaaaatcactgatgctttaccaaaagtttatggggacaatgcacctaaaaaaatcagcagtttacaaatggataacttgtaacaagggaaaagatgacgttaaagatgaaggctgcagcagcaggacatccacatcaatttgcaaggaaagaaattaatcctctttgtgccctaactgaagagtcagccaggtgtggtggctcatgcctgtaataccagcactctgggaggtcaaggcaagtggatcacttgaggtccagagtttgagaccagcttggccaacctggtgaaatccattctctactaaaaaaatacaaaaattagccattcatggtggcgcacgcctatagtcccagctactcgggaggctgaggcaggagaatcgcttgtgcccgggaggcggagcttgcagtgagccgagatcgtgccactgcactccagcctgggtaacagagtgagactctgtctcaaaaaaagaaaaggaccaacgattaacagcagaaacacggccagatgcggtggctcatgcctgtattcccagcactttgggaggtctaggtgggtggaaaaactgaggtcaggagtttgagaccggcctcgccaacatggtgaaaccctgtctctactgaaaatacaaaaactagccgggcctggtggtgcgtgcctataatcccaggtactaggggaggctgaggcaggagaatagcttgaacccaggaggcagaggttgcagtgagtcgagattgccccactgcactccagcctgggcgacagggcgagtccacgtctcaaaaagaaaaaaaataaacagcagaaacaacagccaacaccgacatctctattggttcagcttacacaattctgactgaaaaattaaaagttgagcaaactttccacttgatggctgccaaaaccagatcagctgcagacaagaacagagatttcaatggaaattgtaaacaagtgggatctattaggttgctgcaaaattaattattgtttttgccattgaaaggaatgtcaaaaacagcaatgacttttgctccaaccaatagatcatgaagcatctactgggaaagtgtaacaggaagtgatacgtggctttcccagtatgactctgaagacaaagcactatcaaaacaatgactccaaagaggtgaaagtgatccagtcaaagcgaaatggactggccaagagcaaaggtcatggcaatagctttttgagctgcttgaggaattttacttgttgactttctggaggaccagaaaataataacatctgcttattatgagagtgtcttgagaaagttagctaactctttagcagaaaaatgcgcaggaaagtttcaccagagagtccttttctaccacggcaatgctcctgcttatgcctctcatcaaacaagagcaattttgagagtttccatggaaaaccattaggcatctacctcacagtcaggatttagtaccctctgacttctttttgtttcctaatcttaaaaaatctgtaaagggcaaccatttctcttcagtaaataatgtaaaaaagatctcattgatgtggttaaattaccacgatctccaattccttggggatggatgaaatggctagtatctaggtgctgcgagcaagagacaaaaataaataaatatataaataaatggctagtatcactgcttacaaagtgtcttgaccttggtggagcttatgagaaatatatatatatacacacaaacacgcacccatatatatatattttcgagacggactctctgttgcctaggctggagtgcagtggctgggttcaagcgattctcctgcctcagcctcctgagtagctgggactacaggtgcaccaccacgcccagctaatttttgtatttttaatagagacagggtttcaccatgttggccaggatagtctcggtcttttgacctcgtgatctgcatgcctcggcctcccaaagtgctgggattgtaggcgcgagctaccgcgcccagccttttatttctactttccacacactcttgggttttttttcctcttctttatttttttgagatggagtctcacagtgtcacccaggctggagtgcagcagtgcgatctgagctcactgcaacctttgcctccgggttcaagcaattctcccacctcagcctcccgagtagctgggattacaggcacccaccatcatgctcggctaattttatttttttatatttgtagagatgaggtttcaccatgttggccaagttggtctggaactcctgacctcagatgatccgcctgcctcggcctcccaaagttctggtgttacaggtgtgacgccgtgcccgaccttttttttttttcttttttcaggttttcttcttttttcgagccggagtctcgctctgttgcccagactagagtgcagtggctcaatattggttcactgcaacttctgcctcacaggttcaagcggttctcctgactcagccttccatgtaattggagctggaaggaaaggcacatgccaccatgcctcgctaaattttttttgtattgtttagtagagaccaggtttcaccac[136 bp omitted]ggctcatgcctgtaatctcagcactttgggaggctaaggtgggcagattgcttgatcccaggagtttgagaccagcctgggcaacatgggaaaaccgtatctctacaaaaaatacaaaaagtagctgagtgtggtgtcacatgcctgtaacctcagctactcaagaagctgtggtgggagaatcaactgagcccagaatatcaaggctgcagtgagccgcgactgtgccactgcactccagcttgggtgacagagggagtctttacttaaaaaaaaaaaaaaaaaatctccttataggaacttactgcacatcatgattcattctttctttttttgagacagagttttgctcttgtcacctgggctagagtgcagtggtgccatctcggctcactgcaacctctgcctcctgggttcaagcgattctcctgcttc[134 bp omitted]ctgcctccaaaagtgctgggattacaggcgtgagccaccatgcctagccaattctttcttttttttctgagatggagtctcactctgtctcccaggctggagtgcagtggcacaatctcggcttactgcaatgtccgcctccccggttcaagcgattcttctgcctcagcctcctgagtagctgggactacaggcgtgcgccatcatgcctggctaatttttgtatttttagtagagatgggctttcaccatattggccaggctggtctcaaactcctgacctcgtgatctgcccgccttggcctcccaaagtgctgaattacaggcgtcagccaccctgcctggtgattctttcttataattatactttgatatgttaaggataatgtgaaggaggcctcaaagtagaactaagggtccacagacttttgaagttcccttgtacttctctaaaaagttgtatatattgtttccttcctcaacccaatctggcttccctgtcccataattgtaggtcatcaatgatttgcaagtcactgaatgccatggcctttgtcaggcatcatacttgaccattcagcagcatccaaccctgctggccactcctcttccttgaaacttttctcttggattaagtaacccagagtcttctggtttttctcctattctctggctagtccttctctgtctttgtagatacatttccttacctctatgtaatgttagggttattcaaggctgggccctaggtctgcttctgttcttttctctctccctaaagtgacagaatccatggtcatgacttcaatggacccctaaaaatggatgaattccaaatccatacatccatttcccacctgccattcacccctcactgtaacatggtttgtctcttttaggtcatcagtttcattagttcactaatgaaatcacgactgccaaatccaatgaacacttccatttcttgtcttccttaatctgtggcatgggacaatgtcagccaatctccttcttgaaattttcccttcctttaatcctgtcgcccagctgacaatcattcactttcaatcattattggtggctcttctacatgcctcttgggctacttgtttctaaaagctgaggaaacataaagttatttagaaagtaaaggcaaagtgatgccatgttaggaagggctggcagaatgaatgaaaatcaggcaaaagctcaaggatgttgtctaaacattttgttcttaagggaccagaatagttgatgtggtttggatatttgtccccacccaaatctcatggaaatataatccccagtgttgtaggtggggcctggtggggtgttggggttatggggcagatccttcatggcttggtgctgtcctctccatagtgagttcttacagagctggttgctgtaaagtgtggcacctcctccccgcactcactctcttgctcactctgtgatgtgggatgcctgctcctgcttcaccttccaccatgagtaaaagctccctgaggcctcctagaagctgagcgatgtcagatgctatgcttgtacagcctgcagaactgtgacccaattaaacctcttttcttataaactaacaactcttaggcatttctttatagcaatgcaagaatggcctaacatagtagtgaaccatgaattgatctttccctggtggaaaaaaccaaggtaagctagtgaaggcagaaagtaatatcattcctctcctttcaatacttccaagagatgaattcagtactgtgtctcaaaaaaaaaaaaaaagaaataaaaaataaatatttgcatcaatgaaagtttgttctatccttccctgtacttgtactatgaggacatgctttttgcttctacactacacaaagtcaacagttaccaacaacaatgcaatagaacaagatcggaacaagacttcaaagacactctactccacccaaattaagaaaattcaattcaggatgaacaacagcttttgattttagaaccagcttttacttttctctcatgtcatatgtgatgaagtcctcatttgacatttccctcctgcaaactgcaatgcatgtcctcaccatcagctttttctgacactaaaattaatttgtagaaattgcaaaaatgatgaaattgtacttccaattcggaacctctgatcagattcctgctttgacataaaacttactcctctgccgtgtaccccacgagcagagcgaccccctttctattcttttgccctgaaggcacttttggatggcttaccatgtgccctttggctgcctagacagtcaggacacctaaggccatcaggacttatcacacacctctcctcctcctttttttgttttttttttttgagattgagtctcactttgttgctcaggctggagtgcaatggcacaatctctgctcactgcaacctctgcctcctaggttcaagcaattctgctgcagcctcccaagtagctgggactacaggcacctgccccgacacccgacagatttttgtatttttagtagagactgagtttcaccatgttggccaggctggtctcgaagtcctgacctcatgcgatctgcccgcctcagcctcccaaagtgctgggattacaggtgtgcgccaccacgcctggcctcctccttcttttctacagctaatactactttcctgcttttcttctactggtgagtatctatagttggtgctgtcatcaggaaaatagtgttgatagtggctttgaactcctggatggtaagactgcatccctggacgaccctgaagtacaatgaaatatgttactgttacaacaatgctactaagcttttacatgggattttctttatcataagttatatattaatatatcctaaagcccagtcatttaagaccataaatatgagggcacagtaaatgacaacttctctacttcctctctccatctccaacgaaaagcaaccattttgtaattattattttataagcctgggtaaatttcttttacaggatctgtgtcacccaggctgaagtgcaagtagcacaattgcggctcactgcagccttgacattccagatacaggcgatcctcccatctcagctccctagcagctgggattgcaggcacactctcccacactgggctaagtttttaaatttttagtagagatggggtctccctatgttgcccaggctggtcttaaattcctgaagttaagtgatcctcttgccttggccttctaaatgctaggattacctgtatgagccatcacacctggcccatttcattcctttttttgagacggagtctcactctgttgcccaggctggattgcagtggcatgatcttggctcactgcaatctctgcctcccaggttcaagcaattctcctgcctcagcctccagagtagctgggattacaggtgcccaccaccacactcggataatttttgtatttttagtagagacgggtttttgccatgttggccaggctggtcttaaactcctgaccccatgtgatccacccaccgtggcttccgtggctttcctaagtgctgggattacaggcatgagccaccatgcctggccttttgtgagatttctaaggatgactaatcctatgtatatagctgtcagcatacactttccaagaatttaccaagtgtaatcttggctaccttgaataatgatataattggtttaataaatttttgtagtataaaggacagcccagagacagtaaagaaaaatctaggcagcctgaccccaccctgccatcaaaaacatgtaacatacaggactctttataccaacaaaaggttacaaaacctccttaacctttcctctatggaattaaagataacatctgtgaataccatagaaagttacatcttaattttataatcaaagcttcattactgtctccggactacctaacgtatgcatgctgtggagggtggtccagttccagttcctccagattttgaaggcattaaagcttcatgaatgcccaagtcatcctttttcacttccctggaactagctaccccccactgccctcaccctttcaatttttcctgcctccttcccctagcatcacttctctccaccagagcagctaactccccatggctgtaagcatcatgagaaagcaaccacgttgtgttcactaccatagtgtcagtgccaacacatactaggaggtgctcaaatattgtttagacagccaaggtctgagttgtctccatactacctttatttccaaagaaatcaaacatgtatctgaacaaaaggaggcagaaattgatcaaacacttgctttcctattgtttctaacagtttatatttatttttaaattattatttttttaaattttttgaggcacggtctcactttgtaaccaaggctggagtgcagtggtgtgatcatggctcactgtagccttgacttcccagactgaagtgatcctccagtctcagcctcctgagtagctggggctacaggtgcacaccactatgcccagctaatttttaaaaattattttagagatggggtcttgctctgttgccctggctggagtgcagaggcacaatcttgactcactgcaatctccacctcccaggctcaagcaattctcgtgcctcagcctcccgagtagctgggattacagatgcccaccaccacgcccagataattttgtatttttagtagagatggggtttcaccatgttggccagggtggtcttgaactcctgacctcaagtgatccgcccaccttggcctcccaaaatgctgtgattacaggcgtgagccactgcatccagcctattttatgtttaaattaatagacttttatttgttttatttagaaccagctcttacttttgtttacagttttgggtgagatgcctgcttctacttcaccttctgccatgagttaaagctcccttaggcttcactagaaggtgagtgatgtcagatgtcaaaaatttaatttctcaaaactcatagctatttagtaaagttaataaacacacttagcttcacacttgaatgctgttactatttattgacatcaaaacgaaacaagctgagactaaaagttgctatttaacaggaatagacactggtgcagtttccttcctggagagggtatgcactcagatcatgagacctaagatcaaacacactggattgtcaagagtcaaacaaggactacattttacctcttaatagaaaagatgctgatgacaaaacacgaagtttaaaaatattctttacgctaagctcatataagcaaacaaaaaactaaaactaatcctaaaactttaggacactggatacagaagtaacataactatttaaatttttgtatcaacgaaagtgtgttctatccttcactgtacctgtactacaaggacatgcttgttgcttctacactacccaatgtcaacacttatcatcaacaatacaatagaattagatcggaacaaggcttcaaagcgactctgctccacccaaattcagaaaattcaattcaggatgaacaacagcttttgattttagaaccagctcttacttttctctcgtgtcatatgtgatgaagtcctcacttgacaattccccctgcaaattgcaatgcatgtccttgccgtcacctttttctgacactttaaaattaatttgtagaaattgcaaaagcaatgaaattgtacttccaattctgaacctctgatcagattcctgctttgacacaagacttactcctctgcagtgtaccccaccagcacagcggctccctttctctctattctttgccctgaaggcacctctggattgcttaacgtgtgctctttggctgcctagacagtcaggacacctaaggccatctggacttatcactcctctcctccttcttttctatggctaataccactttcctgcttcctttctgctgctgaatctccagacttggtgctgtcatcagggggacagagtcgatttcggcttcgagctcctggttggtaaagctgcatcgctggacgatcctgaagtacaataaaatatgttaccattacaacaatgctactaagcttttatatgggatttttaagagtcatagttatgtatgaatatatgctcaagtgaagtcatttaagaccaaaaatgtgagggcacggtaaatgacaacttgcctacttcctctctccatctccaaagaaaagcaaccatttggtaattactattttatatgcttgggtaaatttttttttggagatagggcctcaccctgtcacccaggctgaagagcaagtgggatgatcaaggcttattgcagcctcgacattccagactcaaacgatcctcccacctcaggtacctagtaactgggattataggcacgcactaccacactgggctgtttttacattgttagtacaaacaagctctccctatgttgcccaggctgctttccaactcttgggcttaagtgatcctcctgacttggcctcccaaattgttgggattacaggcatgagccatcatgccaggccctaagtgccagttttaaaggaagcacagaagacagaggaacacgttaaataacagcatggggatgtaatctgccaattcagaacaggaaaagccctacaagacaaattggtttctgcaacaaatggtaggaaaacaagagaaggggaaattgtttagattaaaagaaaacttggctgggtgcagtggctcatacctttattcccaatactttgaggggatcggctgagctcaaaagtttgagaccagcctgagcaacatagggagacctcatctctacaaaaaaacttaaaaattagctgggcatggtgatgcatgcctgtagtcccagctactctggaggctgaggtagggggatggcttaagcccaggaggtcgaggctacagtgagctgagattgtaccacggcactccagcctgggtgacatagcaagactctgtctcaaaaaataaactaaaaacaaaagagaactgaagaagacatttcaaggaagcataatttgtggaatttgtttaggtcctattaaaaaaaagacattaggctgggcacggtggctcatgcctgtaatcccagcactttgggaggctgaggcgggaggatcacctgaggtcaggagttcgagaccagcctggccaacatggtgaaaccctgtctctactaaaaatacaaaaattagccgggcatggtggcttgaggctgtagtctcagctattcgggaggctgaggcaggagaatcacttgaacccgggaggtggaggttgtggtgagctgagatcatgccactgcactccagcctagatgacagagcgagactccatcgcaaaaaataaataattaattaattttaaaaagacattaatgaagcaattgggaacatatgaacactgaatagacaggacgttaaggaattattgttagttttttttggtgtgaaaatgctactagggtaatattaatagagtatttatctcatatactgaagtatttaaggaagaaattatgtgcagggtttgtttgaaaataatctagtaggggtagggatgaagtagaatagaaagaaggttggcta[136 bp omitted]ctcccaggttcacgccattttcctgcctcagcctcccgagtagctgggactacaggcgcccgccaccacgcctggctaattttttgtatttttagtagagatggggtttcacc[140 bp omitted]agaatacaatggcgtgatctcggctcacctcaacctccacctcccaggttcaagtgattcttctgcctc[135 bp omitted]cagcctcccaaagtgctaggattacaggtgtgagccactgcacctggcccatcatactattctctattctacttttgtgtatgtttacaatttctata[137 bp omitted]cggtgaaaccctgtctctactaaaaatacaaaaaaataagtcaggcgtggtggtgggcgcctgtagtcccagctacttgggaggctgaagcagaagaatggcgtgaacccaggaggcggagct[132 bp omitted]tttacactttctttacacttgcaggaaaagggaaaaaaaccctcataaacaagtttaatgacaagcagcaccttgtttcttattcgatctctcttgaccacttcttctttcttttcagttttttctgagctgcctattgattctgtactttcagccttctttcctttatcccgaagtgtgtctttctcttttttcatttcttcttcttttctcttaaaagtcttctctttctcatagcgctccttctgcctacggcgctcttcttcttgccgcttcagcctctctctttctcgaagtatgcgctcctgatctcgttcatattcccgttccctctccctatagtctctgccgctctcatcttcaggtctgcatgaaaaacaaatctgagacagaaccctgaaagatcttgtaatcacaaatgcaggaacactgtgattctgatttggcccctgcaatgaggttgcacttttagagcagagtgaaaaatactagtgttttaagaaggaacaaaaccccaaaaccattcacccagattaagatacaagaatattctgaaactgttcctcctcatccccctgccctgcataaaacagcttatcttaattcaggtacatgtccaggacatagcagcaaaactagcatgtataaatcaaacataacaaagagtccttgactactgacctctttggtttttcatctttaagttcgctatcagaacgcttgggcaatgtacaactttgcccactggctctttcatcactgagattctctttgtccaatttcttggctttttctcttttgtccaattctttttcatctcctttttctggcttcttgagcagctttaaagataaaatgtttatttttattttgaaggctgggacactatcttctattaaaaacccagtataccaaatatttaaaatttagactagacaaagccccctatctctgcaggtacacttaatctttcaggtgaacaactagtgcataagagtagtaatttactaaaaggatgctattaatgttaaagtgttatccacttgaacgaagtggtttaatcactttgtggcaataggatcaagactcctttggcttttattctgaggcagggtctcactactctgttgcccatgctggagtgcagtggcatgaacatggctcaccgcaaccttgacctcctgggcttaagtggtcctcctgcctcagcctcttgagtagctaggacaacagatgcacaccaccacatatggctaattttttaatttttttgtagagacaaggtctcatcatgtcacccaggctgttctcaaacttctgggctcacaccatccttctgcctcggcctcccacagtgctgagattacaggtgtgagccactgtgcccggcttcctttggctttaaatgggtcaacctttaagtgaaccaatgcatacttcaaagtatgcttctgtagcaaaccagcatgttgatataacttaatgggaaacagcccacaaattttaagtgataggcagatcgtttctgttgggactgtttttatgtagtacttggaatgacaaataccttggtcaccaaaggagagatccattgcaggaataattttgccttgagcctgagaataacatacttatgatggtacaattatcttgccattagagattaataacaagaattatttggcatttgatttaaaaatctaaaggccttatacaaccaaatagtgaagttccatctctactgagtaggaactctgtatttaatgccatatttacgcatgttcaaaaatgccattgttttttacattgctgctatgaatctctcgagaatacctccaagtgtcggataatcagagagattcttaggcaaaatagaagaatttcaagtctcagagtgaaggtatcacacaaggttcatctcagggtgaaggcatcatgtaaattactaagcaaaaggcaaagcaccacaagacataagcacaaagcattttggcacacagacagccactgcaaatggtgagtccaaaatggacactgagaaggcaccagtgtaaaatgaggataccatgtgcaggtttcattggaagtgctcttatttctccaatgaacatccttattagaaaccaaggtgttcattactctaataagaacattaatgaatgtctctagcatggctggctctaccttctgccttgctgattgttaggaatagcaagtcaagtcacttgtggcatagcagacagagagattgctggaaagaattaagatgagaaactccatcctcccccaagcccctcatcatcagtaatgagccccgtagagacttagggaacccttgctacataaactgctgagttttcaggaaataaaataaggagaccctgccaccctctctgtgagattttctttgactttatctgaagtgctaggtactagtacttccccaggaaatatgttgaaacaagggctgcccaagccatgcccttagaagggaagtggcaaggttgggatctttctgcaggttttcttcttcccaaatgcaatgcatgaatccgaatctgctgctcacagattcccagatatatgcaggaagatactacgggagtcatgtgagagggaaaggcacatattgcagggtatttatccctagtcctcccacaaggcagccagttatgagaagcatataagaagatgagaaagaactatataggcatggttgtcctctggctgtaggtcaatgaagcttctgggcacacagcagagcatcaggaagtcacctgggcttccttttaaagtagaaatttataataaaatagctcagcttttaagaagactcaagtcaacctgaaggggttttcaacaagtaacactaccaccaccaccaccaaaaggacttattagctaagacctgtgtgtgtgacatgatactagatgctctgtatcatgtacttggtccttacatttttctgattcacagcttgtaacagaaacctgtgtacctgaagacagtggaaaacaaacagatgaggtaacttcatgtatcaattatgaagaaaaagctgaaaaaaaaccataaatcatgccagccagccctaagccctcatttactatgaatttagaggacaatagtctaaaaatccaacattttcaatgacaaaaacagcacagatctgcactgaagaaataacatactactttatccttttaaatgatcttaaatttaaaaactaatactattacaggaaagatttttattggatcacttccccccaaaagagaacaaaaacaaaacaaaaaattcatttacaccaacacaagacgcatgcatatttaaagaagtagatacgtgcaatttttagcaacatgcagtcagtttcaacattcttataccttaatctttggttcatcctttaatttgtccctttctggaattctgtctatcttctttagcttttctatatctttcctttttcgtttctcttcttctttccatttcctcctctcttcttctctttgtctttttctttctatttctctcctcctcctttcttctctcttttcttctctcattctctagaaagaaacatcaacacaagccttcaaataaaataatcatcaccaaaaccctaataaatcctgaagtcatggtaggccccaactgaataatctttccttcctactttctacaaagtggcattctaccaccgttatccccactccacccagaaaacgaaagacaatgaagaccagaacctgctaatattattcttccactgctgccttactatctctccagaggctttcagaatatcaaatgagtgtctctgggacaacctaagaacattccacgtttgtagagtgaactcctggtccaacaaccagagtgaaggagcaggctagagagtgagaccaagaaggcaaatccttaaagagtaatggtggaaaaagcagctatttctcctctagaaacccaatgctcttaaaatgtttatagaatgcaaagcaaagaaattaaagtattgagagaactataaagacaaaagatttacctgcttgtttttcaggaagctcaaaagtggggttgtctttttagctacataaatgtaaacagattattaatcatacttatcaacccctagaaacgattccattttctgacattccctgccaaccacccaaggtgggaaaacatgtacaccccttatgcagaaagatcacaattgtaatatcagaaagaagttttacagcattcgatttcaacaatacgggattaaaataccttttaaaaagtaaagaaattcaaattaaaacaacaaaataatttattaaaagagtcattcccaactgatgagaattaagtacttaggacattctcttgttttactgataggagtgtaaacttgttcaactggaagaagttggggggaaggggctaaaaatatctaatccttttgaccccataattccacttctgggaatttattctaagaaagttaccagaaataggcttgtactatccatctattaataaaagtcaagttttggaagaatatttttcattttcaacattctgaataagctattggccttacagccatcttaaaacacatattcctggccgggcacagtggctcatgcctgtaatcccagcactttcagaggccaaggcaggcggatcacttgaggtcaggagttcgagatcagcctggccaacatggtgaaaccccggctctactaaaaatacaaaattggccgggcgtggtggcggacacctgtacttccagctactcgggagactgcggcagaatcgcctgaacccaggaggcggaagttgcagtgagccgagattgcgacactgcactccagcctgggcgacagagcaagactccatctctcacacacacacacacacacacacatacacacacacacacacacacacacagagagagagcgagcgagcaagcaagcaaaaaaaacaaacaaacaaacaaaaaaaccccacatattccttaggataaattcctgagtagaaatcctgggtcaaagattatgctcatgtttagagctactgatacagtagtgacagcctattactgagaaccaagatccaagctagaattcctcaagtagttttcaattttgcagtaactaatttcattttttcgtattttcaagtcaaaatttttttaggaatatgaacttattactagaaaataccaattgaccttcaaaggcttaccactgtctaaacattccttatcagtcatcgaactttttgtatttatattacatttgtgtgaaactaaataggtcaaagaatttttcccactttaatggattctcataatgctgtgaggcaggtattaccatctgcaatttacagtaacagtctcagagaaactagtaacttccctgaagtcacacagctagcaactgatggaggtaggagacttaggtactgtgatgaaaagactgttgccctgattctttttgcccacttacctattaattctctattttttgcttctatttcctctagcagtgtctctggagtagatgtcattttctcattatctgtggcataactttccaaaaactttctatattctggatctaaataatcatttgaggaaacagaaaatataatagactttaaacaaaaaaagaagacattatctacaatactgatttatcaaagaagataattttttacttcgtggaagattaaaaaaaaccaaaccatacccacaaggtagactatttagagcttaattggtcacttgctctcaggactcctatcactgatactcactataggaatctggtataacatggggtcaggaaaaatgagacgccatgcattataacagaaccactaggggtattacatagtttgcttttaaaagtcactgtcctactaaactaagttaggtgttccaaaaagataaattagagagaagtcctagatgtggcacttgaggtgatgggaattcctggagttctctcctagacctctaacatcagaaagggtgacacatctaagccattatattgcttgtttctatgtgtcacttgatcaagtcttccagatctaaatctgtaataaaaccagtatcacagctatgtgttattgagtccttaccgtgttttctttataaaatacctgtaatagtaacaaatgatggaaattaaactagatgattctaaagtaacaatctgatataaaatatggtcctagtccttatccaacataaagagttgtgtaacagctatctaacataacattacagaggtctcaaaatctggagccagtgtaccttaaatggcaattattttggtttttcagttcttgtatttctttctttctttctttttttttgagacggagttttgcttttgttgtccaggctggagtgcaatggtgcggtctcagctcactgcaacctccgcctcccgggttcaagtgattcttctgcctcagcttcccaagcagctgggattacaggtgcccgccaccatgcctagctaatttttgtgtttttagtagagatggggtgtcaccatgttggccaggctggtctcgaactcctgacctcagcaactctgcccgccttggcctcccaaagtgctgggattataggagtgagccaccgcgcctggcctcagttcttctattcctgttcaacctaatactatgtgtgtagctaattgtatatccaaagaccagaaaataggagtgacaacttcagctactttatacaaagttacctgggtatggaaattttcccatgacagttcaaaccttcttctttataaatataatggaaaccaaaagtcaaataaataatcataaaaatggtgaggcctcaagaagcacctgttaaactttgaaacctgatttttttccactattttctttttcttttttttttgagatggagtttcgctcttgttgcccaggctggagtgcaatggtgtgatctcagctcactgcaacctccgcctcctgggttcaagagattctcctgcctcagcctcccgaatagctgggattacaggcatgcaccaccatacccggctaattttatatttttagtagagacagggtttctccatgttggtcaggctggtatcaaactcctgacctcagatgatccgcccgccttggcctcccaaagtactgggattataggcgtgagccaccacgcctggcctttccactatcttctaatcaataaacctatggtgatttgttactcaatagtcaacattatattgttcaatggttgaagaatgaaatgccctagccaaagagagcagagattctgtgcaagaaactctctctagtctaacaattaagcaaagcttccatcggcaaataacatttctcacttactttattttgtatattttctaatttaaaattttggggtcgaattaactctcacaaagatattatttttaaaaaccccacagcaatagcattatataattagagctatactgtaccatcatcgatagtcccgactttggtatctcttttcttagtcttcttttttgcagctttttgaaaaggtgcaaattctactatagcgggatattcctgacctgtttagaaaaaaaataccacacttgctataacaaagaaaatgtcaaaagtggatataagggaatcaacccattgctttctatgactcttttgatggcagtcatctgaagagggtctcccaaaggcataaagcacactggcacaaccataatcaacatactacaaaaggagccacaaattcacactgataacatagtgaaacaacacggcatgaaagtaaaatattcatataaattcaacttataaaatgtgatattttaatgtgaaaaagaccctacaaactatttttcattttaaaatgttagaaatctccaaaataggcaaatctatagagacagaacgtagagtagtagctgcctggagtttggggtagaagtggtgagaagaatgaggagtgacaactaatgggtggggtttctcttaggggtgatgaacatgttctaaatttagattgtggtgataggctcataagcctatgaatatactaaaattcactgaactgtatactttaaaagggtgactatttcaggcatgtgaattatatctcaataaagctgttattttttaaaagtgtaactatttgaggtgatgtgttatgtgaggtgatgaatgtgttaacttgattgtatatatttcataatgtatatatgtatacattatgtatacatttcataatgtatatatgtatacaatatgtatacatttcataatgtatacatttcataatgtatacatatataaaattatcacgttgggctgggcaccgtggcttatgcctataatcccagcattttgggaggccgagatgagaggatcacctgaggtcagaagtttgagacctgcctggccaacatggtgaaacactgtctctactaaaaatacaaaaattagctgggcgtggtggcacgtgcctgcaatcccagctactctggaggctgaggcatgagaatcacttgaacccaggaggcagagattgcagtgagccgagatcatgccactgcactccagcctgggcgacagagtaagactccgtctcaaaaaaataaatacataaaaataaaaataaataaaaatacaaaaattagccaggcgtgatagtgcacgcctgtaatcccagctacttgggagactgaggcaggagaatcacttgaacctgggaggcggaggttgcagtaagctgagattgtgccactgcactcgagcctggtaaaaaaaaaaaaaaaaaaagaaaaagaaaaaagaaaaaacaattattacatagtaaaatttaaatatatattattttatttgtcaattatagctcaataaagctggggaaaaatctgttaacacttaaaaaaaaatacaccaggacaccaaaagcacaggcaacaaaagtaaaaatacagagggtagatctcatgttaagtgttcttaccacaataaaacaaaaatataaagtatatctcttatttaaaaaaagtaaaaaatagataaattggactacgtcaaaattagaaacttctatgcatcaaaagacacaatcaacagagtgaaaaggcaacccatggaatgggagaaatatttgcaaattatattatctgataaggggtaatatcgagaatatataaagaactcctataactcaacaacaaaaaaccaaataacccaatttaaaaaatggtcaaaagacttgaatagacatttcttcaaagataatatacaaatggctaacaagcatatggaaatatgttccacattactagtcattagggaaatgcaaatcaaaaccacaatgaggtatcatctcacgcctattaggaggactactatcaaaaagcagaaaataacaagtgttggcaaagatgtggagaaactggaacactcatgtattggtgggaatgtaaaatgatgcagctgcatggaaaacagtatggcagttccataaaacattaaaaatagaattattgggccagcctgactaacatggtaaaaccccatctctactaaaaatacaaaaattagctgggtgtggtggtgggcacctgtaatcccagctactcaggaggctgaggcaggagaattgcttgaacccaggaggtggaggttgcaatgagggaagatcgcgccattgtacttactccagcctgggcaatgagggcgaaattccatctcaaaaaaacaaaacaaaacaaaaaagaactaccggcggggcacagtggctcacacctgtaacctcagcactttgagaggccgaggtgggcgcatcacttgaggtcaggagtttgagaccagcctggccaacatggtgaaactccgtctctaccacaaacataaaaaattagcagggtgtggtggcaggtgtctgtaatcccagatacttgggaggctgaggcaggagaattgcttgcacctgggaggtggaggttgcagtgagccaagatcatgccactgcactccagcctgtgtgacagagactctgtctcaaaataaataaataataaaataaaaatagaattaccaaatgactccagaaattccatttctcggtatatatccaaaagcagtgagaacaaggactcgaatatgtgcacatctgtgttcataacaatattgttcacaatagccaagagtggaagcaactcgaataccccttgacagatgaatggatacacaaaatgtggtatatacatatactggaatattagtcttaaaaatgaggctgggggcagtggctcatgcctgtaattcctagcattttgggaggctgaggcaggcatgtcacttcaggtcaggagtttgaaactagcctggccaacacagtgaaaccccatctttaccaaaagtacaaaaaaattagccagctgtggtggtgggtacctgtaatcccagctacttgggaggctgaggctggagaattgcttgaacccaggaagcggaggttgcagtgagctgagatcgcgccactgcattccagcctgggcaacaaagtgagactccatctcaaaaaaaaaaaaaaaaaaaaaaaagatgaaaattctgacacatgctacgacatggatacaccttgaagatattatgctaaatgaaataagccagacagacactgtatgtttccacctatatgtggtacctacagtagtgaaactcatacagacacaaggtataatggtggttgccaggggctggaggaagggaaataaggagttgtttaatgggtaaagagtttcagtttttcaagatgaaaaagttcccaagattgttgcacaacagtgtgaatataccttaatgctactgaactgtacacttaaaatggttaagatggtaaattttatgttacgtgtatttttacaatttttaaaaatgcaaaaggaatgaggtaatgatatatgttatatgttacaacatggatggaccttgaaaacattgtgctaggtaaaagaagccagtcagaaaagaccacatattgtatgattacatttatatgaaatggagggaaatcatagatacataaagtagattagtggttgccaggggctggagggagagaatgggaggtaactactaatagatatgggtttctttttggagggatgaaaacattctggaattagtactgatggttgtactaccttgtgaatataccagaaaccactgaattgtacgctttaagaggatgaattttattataggtgagttatatttcaatacaaaaaccccaagtgactaatgggaaaaaaattcacaagcaccctgtcacagaatgtcaaaaacaaggtatcctatccttaaatcattggcatgtagacataagcagaaaaataaaaataaacagaattgaccagaaggcactgcaaagcagtcatggaggaaaaattatgttgggaatcccagt[137 bp omitted]catggtgaaaccccatctcctaaaattacaaaaattagctgggcgtggcggcacacacctgtaatcccagctaagtcggcaggctgaggaacgagaattgcttgaacccaggaggcggaggttgtaatgagccaagattgtgccactgtactccagcctgggcgacagagttaagactctgtctcaaaaaaaaaaagagagagagagagaagaaaaagaaaaaaaacaaaaataaaaaccaaaaaacaaaactgtgatatatttgagaaggaatagataaaccagactgaaacagagggaaattgtggaagacaggctgaagaaacagaagtgaggccagaatatggaggaccctgactaccaggctaaggagtttggactttttcccccaactgttaatttaaatcattattttcaaaaagattaatttcatggcaatataatagactgaattatacaagaatgaaaaaaatggaaaatcctgtaagtttagagacagtggttgtctaggcattaagtgatgaggacataaagtgtgactgtttaaggctaggtgaacaagatattaaaaaaaaacaataaaatccagcctgggcaacataagcagaccttgtctctaagatttaaaaacaaaacaaaacaaacaaacaaacaaaaaacacaatgaggaaaggatagtctctttaataagtggtgttgagctgggtatggtggctcgcacctgtaatcccagcactttgggaggctgaggtggggggggggaaatcacttgagcccaggagttcaagaccagcctgggcaacgtagtgagaccccatctctataaaaaatttaaagaaaattagccaggcatggtgacatacatctgtagtcccagctactcaggaggctgaggtgggaggattgcttgagtccaggaattccaggctgcagtgagctctgattgcgccacagcactccagcctgggtggagaccctatctcaaaagataaacaataaattgacaagattcataacttacatgtaagagatttttaaaaaaggaaaaaattaaacacaactcagatttccaggctaagtaactagaatctagttaaatatctactggaataaaatagttggagtggaaaaatagctggcttggggagattaataaaagttggacaaacagtggcaatccttcaatttttactggcatagtccctgacaaaaatttaatttttaccaactttgaagtaatattgaaaaaaacaaaacaaaacaagaagacacactatttacctataattgcaaaccaaaaagaaaagtggcaaatggcagcttagatattctctggctaaatgtaggtagcagataatagagtgttaaagtagaaatgtgtcttccctatagactggacctttctggatataaagtaagagatgtatcaagtttctttttttcgattttgagacagagtctcgctctgtcgccaggctggagtgcagtggcgtgatctcagctcactgcaacctctgcctcccaggttcaagcgattcttctgcctcagcctcccaagtagctgggattacaggcgtggaccgccacgcctggcta[131 bp omitted]ggccgagatgtatcaagtttcatgttttaattatatacaactttgtgagaatgttaaacagtatcccaattgggaactgttggcttaatggatttgaattaaataaatgtttgtcctcgaagcaaaataagaagtaaatatttaaaacttatcaaacaagtttaagagtcacttatcagtactgcggctgaaattctacagtcaaaacagcaggtttaagccagggcaaaaaatgtgtcacacgaggagaaaacagttgcaatttcactcagttgatcaaactaaaaaaatagtaggttaataaaaataaccaaggactgtgaaaagtcacgtctatttataagactgcaataagcttattaaatgtgtaaaactctaggaagcaacgcaatgcacgagttgtcttaaacatacaaatgacaaagaaattccctttttacttcagttaccaggactcacctttattgtcaaggaatacataaccatcaaagcgatccctgaacaaaataatgtcctcttggtttttaaagttgatgtatgctctggcatacatatgaggatacaaactgcagagaggaaagcaattatgtaaatgtactcgcaggtgtctggcccaattacaagtatgcatatattaaagacaagctcaaaaatcaaatgaaaaacagtaggataaaaagaatgaaagaaacctttttcatttacccctttccttttttttttttttttacctcgtatcattagaaaaaaactcaaaataatcatgctcaggcataggttgaagatgttcctgaagctgctccttggtcaaagtgggaggtaatcttcgaattaccaccttaagaaatgcataaggaaaataaaattagtacaaatcagttttctgtcatacctgaaagaatcacagttcctgaagaaggctgggctttaaaatatgagatcacttgtaaaaacccaggagaaaatattcttctgcagcccaatgctcagaattagtcaaacataatagtaacgcggtttaaaaaaacccttggaaatgagaaccacctggagcaaggaaaaatcgcaggttttgctctttacagcagccctgcagtttaccaggtttgtgcatcattttcgatcacccattttttaacagatctagtggcaataacttagtaagccaacgctggtctttgtgggtgccacgaaatcttgatttagcaacaagtttctcccacgtccaacacatcttaaaacaaaatccttgcccattgaacttaagaattcaaaactctaacgaatacaaaaaatctacccattgctctcaaaataggatgctctcgatctaccctcctgtaccattaatcaccctgcactctcccccaactcgcctccatgaataatattcccatccctcatgtctccttcactatttaatatttctccccaattacacctttagttcctcattctttataccgtcgctcttccctcccattatcatctcacagctctgacctaaacccttcccgtttggggagtcccctcttttcctcacccccacccaggatttggccgggaggggctctccccatttcgggtgaatggatgaaccaggatgatgcgacttccattcaggcgaagagatagaaggagaacctgagaaagaaagggggcagccccattcccagccatcctccccgcgctgcggactcgtcccgccctctcccgggccagcggccgaccgggcaccttgctcagcgcttctttcttctccttgttgcgatcctgcttatcttcccccttggagctgtcccccgaggtcccaccaccgctgcctgtggccccggcgggggttaacagggttactcgcttctccttaggcctgtgctccttctcttccttcatggctacgtcccccgctgaagcggcttggccggaacggggttaccccgggcacaaacggctcccgggaagctcccgtcaaagctccgcccccaacaaatgccccttgtgataagtcgggccccacgttccattgggtcctgccaagctctcgcgagacttgggcctttcccagtgcaaaggttttaacacctggtttttacttcccgcccgccaagttcctgcgccacccaatcccctcgcggcccagactccctcggggcccgccccttcgcgcgtcattagcaattccgccatcttgaagtgactctgtcggggactacaaatcccggcatacaaagcagctacccgcttttgttgggcgttcaggggccagagctatctcagggtccctgtttgtgagtaaatcgaatcctttcatcttcagagttttccaggtcgaaagataggttcttcacgcttagtttccatcagataaactcaatgccgtccaaattttgcctcactaggggagcgacttgtattttttatcattgaattcagaggctttagcatttattttcctacaactaaaagaaaaagcctaacatttaaaaaactttattttccttatattgattaggatttacagatacttagtaaatactacaatattagccgagttcagtggcgcacgcctgtagtcccagctgctcgggaaggttgagaagagaggatcttgagcccaggaattcgaggctgcagtgagccatgatcgcgccgctgcactccagcttgggcgacagagcgagaccctgtatataaaaaagaaggataataataaataaacacaagatactgatatttaaaggagtaatatgactaaaatatacaagatttgttttcatcaccttattttagcaaaaggatccttctccccaggtactgatgtcccacagggaggggaataaaaataaaacccaacttgatttagttgcgatcaccatcttcacttaaaaagggccaattttacattatttataataactccaaactggaaacaatccaaatgtgaatctaacagtgattatgttgagtgacagaatctagacacagagtacatgttgtacaattccatttatatgaaattttagaaaaataaaaccacagtgatagaaagcagatcagtcggccaggcgtggtggctcacgcctgtaatcccagcactttaggaggccaaggtgggtggatcacctgaggtcaggagttcgagaccagcctggctaacttggcgaaaccctgtctctactaaaaacaaaaaaaattagcagggcgtggtggcacattcctgtaatcccagcactttgagaggccgaggccggcggatcacctgagatcaggagttcgacaccagcctggccaacttggtgaaaccctgtctctactaaaatacaaaaattatctgggcatggtggcaggcgcctgtagtcccagctatttgggaggctgaggcaggagagtcacttgaacctgggaggcggaggttgcagtgagccgaggttgtgccaccgcactccaacctgggtgacagagtgagactccatctcaaaaagagagagagacacagacacccatagaggacagaaaccaaattaaagatgcaataggagcccaaggcagaaagctgcctaagggccaactcccatttttgccgacctctagaatatattcccctgactctgcacttaaattttctcactccaattgtccagcctattcttggattcctattcctgtggctaaaacggtttccctgtatttgacatctgttactcttgctttcagtacctggccgttcttatgagccttgtttatgcatctgcctctgacctactgcttagctctgcacttgcatgttggtagtgtatgcctctgttttggtgtcctcactagctttaaaccaccagctgtttgtcagttgccagaataaagtgtcccagggctcagtccttagacctcttttctatgtacactcactcctttattaatctcattcattcttttggcttttctgtctttgctgacaactctac[133 bp omitted]ctactaaaaatacaaaaaaattagccgggcgtggtggcaggcagctataatcccagctactcaggaggctgaggcaggtgattcgcttgaacccaggaggtcgaggttgcagtgagccgagattgtgccagtgcactccagtctgggcgacagagcgagactccgtctcaaaaccaaaacaaaacaaaaaaagaatttacatctccagcccatacctccctgatgatttccagagtcatgtatccaactgcctattgaacatctccacttaagacgtctaacgtgttcagccaccgaatgcatccaaaactgaacacttgatcttcccccacaccaactgtattagcctcctattcctgctgtaacattaccacaaatttagtgggtttaaataatgcaagtgtattatcttacagttctgtaggttaaaagtccaacaaggttttagctttgtcctgtgagggggcaaaaaaatatagtaataataaataaacaaacagtccaatatgggtctcactgggctaaaatcaaggtgttggcaggactgagttccttcctggaggctctaggagataatagatttccttgtctttttcagattcttgaggcggcccatattccttggcttatgaacccttcgtcttcaagcatctctctctgaccctgcccctacttctgtctattgtctatatctcttttattctctgccttgccattccaagtttttttttcagggtcacagttcactgaaggcttaaactcctgagctgaagtgatcctcctgccttagcctcccaaatagctgggactacaggtgcatgccaccatgcccagctaatttattttcatttttgtagagaaggggtctcactgtgttgcccaggctggtctccaactcctggcctctgcactttcccctttcactttgaaggactcctgtgtttacattgtgtccgcctgtaaaatccaggataatctccctattttaaggacagctgattagcaacattaatttccttttgctatataacctaacacagtcatgggttctggggattaggatgtgtacaactttgggggagatattattctacctaacacatactgtagacttcctttttgatgaaacttttaattgcagtataacagatgtacagacaagtgcactaaaagtaagcatccagcttgctgaattttcacaaagtgaacacacttatgtaaccagcatgtagatcaagaaacaaaacattgccagcactccagatgctctcttcctacttgttcccagtcattttcgccaccaagaataccactatcctttttgctttttcttttttagcagctacatccttttatgaatgacttctaatactattgagtttgtctgttttgaactttatgtaaattgaatcatacagcatgtattcttttatgttaggctcctttctctcaacatttatgactgagatttctttatttatttatttagagacggaatctcgctctgtcgcccaggctgaggtgcagtggcgccatcttggcttacatcttggctcactgcaacctccacctcccgggttcaagcgattcttctgcctcagcctcccgagtagctgggagtacaggcgtgtgccaccacgcccggctaatttttgtatttttagtagaaatggggtttcaccatattggctgttggatacagtgagatctagatctctcttcaaagaatcagtatgtcagtatgttcagttctttgtcctccattgtaaagtttaacttcctcgtagtttcagtaaacaacattttccaccagttttcatcagtagttcacatctgttcccctggttacctgctccgtcctgactcaccccggtcatccgctttgacctgagtcacccctggtccctgctctgacctaagtcacctttagttacctgttcctaaccgtccttcccaccaaactattcaccccgccactctggctcatacccctggtctctttaaagtagccaatcagaattagcttagactgtgcagtccaaccctagccaataggggagcgacacagcagtaggggctacctgtgtcaggaataagaaccccttcccctcccttgttcaggtgtgctcttgccattactccattcacgagtcgcacccttctatagaagtaaaaattgtcttgctgtgaaaattaaatttatgttcgagtgctatttctttgtggcaccgaggaacaagcattt[136 bp omitted]ccttttcactgttacataatattccattgtatgagtctgctgcaatttatcccactcttaggggctaatacaaatagtgctgctgggattttagtgcatattgtttgatgattcatgtcagatacatacctaggagtggaattgctggatcacagagtaagcatatgctcaactttagtaggtactaccatagagttttccaacagggttgtaccaatttacacttatcagcagtgtgtgagagtcctgagtgcttcatacccttcccaacatctggtattgtctcgtgggtgtgtaggggtgcctcattgtagtttcactttgcatttctctaatgattaagttaagcaccttttcatacatttttcactgtgtgcctttctatccttttggttattgcaccaggttattatattatttatgccagagcaaaagaaacaaaacaaaacagggatggtgatatggctcctttccaccaagtaagggggagaacaagaataagtgtgtgcgtgtgtgtgacagagagggagaaagagagctgtccctaaagttcctcacaccactgattctcacagtttcactgtatgctccaaggttcctcttcccacttctgatgatgagcagtatcatgtttgggaccccattttagaaaagtagaaggaggctctgcctgtaatcccaacactttgagaggctgaagtgggaggattacttgagcccaggagttcaaaatcagcctgggcaacatggcaaaacccgtctccacaaaaaattaaaaaattagccgagtgtggtggcacacacctgtggtctcagctactcaggaggctgaggcgggaggatagcttgagcccgggagttaaggctgcagtgagctgtgatcgcgccactgcactccaacctgggtgactgaacaataccttgtctcaaaacaaacaaacaaacaaacaaaaacccagaaagaaaatatctatacacaaatggaagaatcttactttaaaacatcttccctgccctccattgaacaggctacttttaataaattgtcttgcccgttttttattaattcctttcacaaataaaactccttgtggaaatcttgtggaactgcctggtgttcagctccatctagcttaaaggtggtttaatatccaattttaagatcaagttgacttttatttaaatgttatattcaatgttgtttttaattaattcttgacccagatcagctctgaaattatccaaattctaaacagataattaggaaaggagttggataatttgtacagtacaaaaaattatttcacatgagcgcctgctgatcctaatattacctatgaaagaaagggtaatattttatgaattagccaagttaaaaatatgtatgagaacgttggactccttcccagtcagtgcataaaggaggcttacatagtataattatttgaagtaccttcccacagtttaaggattataacgaaagatgttaaccagctattcctgatgtctactgatgacataaaacaggaggaggtggccgggcgcagtggcttgataatcccagcactttaggaggccgaggtgggcagatcacttgaggtcaggagttcgagaccagcctggccaacatggtgaaaccccatctctactaaaaatacaaaaattagctggaagtggtggcgagcacctgttatcccagctacttgggaggctgaggcaggagaatcacttgaacctgggaggcggaggttgtggtgagcaagattgcactactgcactccagcctgggcaacagagtgagactctgtctcaaaaaaaacaggaggagctaatgaacaatataaggaattcagtcacatgggaaacagagatgaatttctcaattaagaaaagtttttagtttaaaattggtagctgagccttggaggagtgacattagattctgagggagaatacaagttgagtatgccttatctgaaatgcttcaggccagaagtgttttggatttcagaagtgtttcgaattttggaatatttgcatatatgtaatgagataacttggggataggacccgagtctcaacatgaaattcatttatgtttcatatgccccttgtacacagagcctgaaggtaattttaattttttccttggagacactgaataaactgtgtgtcgtgtgcctgtgttttgtctgtggcctgtcccacgaggtcaggtgtggaattttccacttgtgatatcatgtcagtgctcaaaaagtttcagattttggggcatttcagattttggatgctcaaactgtaccacacatgtaaactttatttatttatttatttatttttgagatggagtctcgctctgttgcccaagctggagtgcagtggcataatctcggctcactgcagcctccacctcccaggttcaagctattctcctgcctcagcctcccaagtagctgggattacaggcgccaggcatgggactaatttttgtatttttagtagagacgggatttcaccatgttggccaggctgttctcaaactcctaagctcaagtgattctcccgcttcggcctcccaaagtgctgggattacagccatgagccaccgcacccagccgcactcatgtaaacttgtaagtaaatccagtaagctttaaaaatcctgaagttgtgtaattttctcaggggaataattttacaggtataagcgtagaaaattatcagttctatttctataatgtagacttagaaagatcctgtgtactgagagtgagatgaaatttggacaaaaggagacttatggactttcacaacaacaaaacaatcatgatcaaagcttatttttgccctgtgctgggcactttgtgtgcgttgacttggttagtcctcacaccagccctatgaattgggtactgttgttttccctattttgcaatgagtgaaattaagacacgtggtcactcaaacccaaaattacatggctagaaagtaatacagctgattcataaatctaaattacatctccaaggctggtagttaaaaaaacaaaacaaaacaaaacgaaaaccctaaatcctgtgagtttgtgtaggggctattaaaaaaaactagaaaaaattatagagttatcttaaaaatactggtaaattctcagatgtaaaagtaatgttaataaaattaataaaatgtttgttacattacaaaaatatgaagagattatttatgtcaaatg[143 bp omitted]aacaccatctctactaaaaatacaaaaattagccaggtgtggtggcacgcacctgtaatcccagctacttgggaggctgaggcaggagaattgcttaaacctaggaggcggaggttgcagtgaaccaagaccatgccattgcactccagcctgggcaacagatttga[131 bp omitted]aaacccggtctctactaaaaatacacaaaaaattagctgggcatggtggcgcacgcctgtagtcccagctactcgggaggttgaggcaggagaatcacttgaacctgggaggtggaggttgcagtaagctgagatcgcaccactgcactccagcctaggcaacagagcaagactctgtctaaaaaaaaaaatagccaggcgtggtggtacacgcctgtaatcccagctacttgggaggctgagacagaagaattgcttgaacccgggaggcataggttgcagtgagccgagatcttgccattgcacttcagcctgggtgacagagtgagacttcgtctcaaaaaaaaaaaaaaaaaaaaaaaaaaaaaaaacaaaagaaacgaattagattaaagaaagctctgatatatagagctcttaaatccctcagaatttcctggatcatagtagcatcttttgttttaatgaggtgactcttggtgggatcctggatagcctcaggatgggggctggttgccaggggaaccaatcatgtaattagagggttggaactttcaaccccacatcaccccacaaacctagacctctggggaggggagaagggctgaaggttgagttgatcaccaatggccagtgatgtaatcaatcatgcctatgtaatggagcctccatagaagtcccaaaggactgagttctgagagcttctggctagctggacatgagttaccttgagggtggttctgagagagagagcatggaagctctgggccccttctcacatgccttgccctacacagcttttctatctgactatttgtctatatgcttcgtaatatcctttataataaatgagtaaatttaagtaaagtgtttccctgaattctgtgagctactctagcaaattaatggaacctgaggagagggtagtagaaacccctgatttatagctggtgggtcagaagtatagatgacaacctactacttactattggcatttgaggtggggggcagtctcataggactgagccccaaatctctgtataggatctatgggatctgatgctatctccaggtaggcaatgttggaattgaattgatttagaggagatccagctgatgtcagctggagaattgcttggttggtgtatgtgtgtatttccccacacattttggtgaccacaggtggagtgttctgtgtttccttgagtgtgagagtaggaaaaacactttgttttgttttcctatctttaaaacatccaaaaatcaattactgtaatagaccatatcagtagaataaaaagcaaaaaccacataatcatctcaaaagatgcagaaaaaatatttgccccaaatccaactccttttcatgataacaacactcaacaaactaggaatacaggggaacttttctcaactcagaaaagagcatctacaaaaaactcgcagctaataacatacttagtggtgatagactggatgttttcctcctaagatcaggaacaagagaagaatgtctaatctcaccacctctattcaacattgtcctggaagctccatcaatggcaactgggcaagacaatgaaataaaatgtattcagattgtaaaggaagaactaaaactttattggcagatgacatagtcttggttcatgtacatagaatatcgtggtcatgtatatagaaaatcctaaggaatccactaaaaaacaacctgctaggaccaataaatgagttcagcatggttccagtatataagatcaatattggaaaacaataaattttatttctatatgctgttgatgaataatctaaaaatgaaattaagaaaattattctatttgcaatagcatcaagaacaaaatattaggaataaatttaacaaaggaagtgcaatacttattctctaaatactataaaacattgtcaaaagaagtaaaagatttagctgggtgcagtggctcatgcctgtaatcccagcactttgggaggctgag[132 bp omitted]gaggcaggagaatcacttgaatctgggaggcagaggttgcagtgagccgagatcgtaccactgtactccagcctgggcgacagagccagactccgtctcaacaaaaaaaaaaagaaaaaaaaaattagccaggcatggcgttgtgcacctgtagttctagctcctcaggaggctgaggtaggaggatcacttgagcccaagagtgtgaggcttcagtgaactataatctggccactgcactctagcctgagtgacagagtgagaccctgtctctttctctctctctatatatacatatataaaaagttaaacataaacttaaccatatgacccagcaactacactcctaagtatatacccaaaggaattgaaaacagacactcaaacaaatacatgtacacccatagtcagagctaaaaggtaaatgaacaaatatccatcaacagatgattggttaataagcaaattgtgttctatgcatacaatggaatactgtttagccatagaaaggaagtactgatacatactacaatgtggatgaaccttgaaaactaaatgaaagaagccagacatgaaagattccatattgcaattccatttatatgaaatatctaacataggctgggcgaggtggcttacgcctgtaatcccagcactttgagaggccgagacgggcagatcacgaggtcaggagtttgagactagcctggtcaacatggtgaaaccccatctctactaaaaatacaaaaattagcagggcgtggtggcgcgcacctgtaatcccagatacttgggaggctgaggcaggagaattgcttgaacctgggaggtggaggttgcagtgagctgagatcactccaccgcactccagcctgggtgacagagcaagactccgtctcgggaaaaaaaaaaaaaaaaaaagaaaagaaatatataacataattaaatccacagagaatgcagattggtggttgccagggattggggggggggttggtggaggggaggaggaaatgaggagcatttgcttaatgggtgtggggttttcttctggggtgatgaaaacaatgttttggaactatatagaggtggtagttgcacaacattgcaaatgtattaaataccactaaattgtttgctttaaactggttaattttatgttatgtaaatttcacctcagcaaataaaaaagtgtttacagaaaggttcaacagccaggcgtggtagctcacatctgtaatcccagcgctttgggaggctgagggatgaggactgcttgagcccaggagttccagagcagcctaggcaacatagggagaccactgtctctaccaaaaaaaaaaaaaaaaaaaaaaaaaaaaaaaaaaaaagccgggtatcatggcccacacctgtagttccagctacttaagaggctgaggtgggaggatcacttgaacccaggaggcggagggtgcagtgagctgagatcgcgccactgcactcctgcctaggtgacagagtgagactgcatctcaaaaaaaaaaaaaatcaatatagtgattaagtgattacctgagggtgtgatcctgagatcctgagatcctgagatcctgagggtgtgatcctgagatcctgagggtgtgatcctgagggtgtgatctggaggggatccttgaggggcttcttcagtgttttcagtcttgtagttcttgacccgggtggtggttatgcaggtgttcttctataattattggttctattacaaagttgtgttttatgcactttcctgcctcaggcctttgtactaggtgttctctgtctggaatgctcttctccccgatatctgtttcatgtaggtctctgcccaaatgtcaccttatcagaagaggcccctccctgactaccatatataaaatagcattcccctacacccctgcactcttagcccattaccttgctttattgtttttcatagcactcatcacaatctgatatatatatatatatctgtcactgtctctcatgtatgttctttttttttttttttttttttagatgggttctctgtcacccaggctggagtgcagtggcatgatcacatctcactgcaacctcaaactctcaggctgaagggatcttcctgcctaagcctcctgattagctgggactacaggcacatgccaccatcccttgctaagttttttattttttattttttgtagagatggggtctcactttgttttccaggctggtctccaactcctggcctcaagtgatcctcctgcctcagcctcctaaagtgctgggattacaagtgtgagccactgtgctcacttcatgtaagttctatgaaagcagggacttgtgtgcttttgtcatgactgtatctccagtgcttaatgcctgtcatgtaatgggtgatcaatacaaatttattaaatgaatgttcacagccaccagtctagtccagtctaccatcatctgagttggaccagtgcaccacccccataactgatctccctgtttcatgtctggctgccttcaatccattccccactcttcagaattatctttttgaaatttagatctgatcatttcattttcctttttaaacccttaaaaaaattttttttttgggacggagtctcgctctgtcacccaggctgcagtgcagtggtgcaatctcggctcactgcaacctctgtgcacccccgaccccgggttcaagcacttctcctgcctcagcctcctgagtagctggaaatacaggtgcgtgccaccacccctggctaatttttgtatctttagtagagacggggtttcaccatgttggtcaggctggtctcgaattcctgacctcgtgatccatccacctcggcctctcaaagtgctgggattacaggtgtgagccaccgcgcccagctccccccacttttttttttttttttttttgagacagagttttgctctgtctcccaggctggagtgcagtggcacaaccttggctcacttcaacctccaccttccaggttcaagggattctcctgcctcagcctcccaagtagctgggattaaaggtgcccgccaccacacccagctaattttttgtatttttactagatacgggggtttca[141 bp omitted]aagtccaaagtccttaacatgacttgcaaggtgtctgctctttggccctgactaccttgtctcttttccccagccaccttagactgccttgagtttttagctggaggcagtctctcacatcagggccttagtatatatacttgtccctctacctgagatactctttctccaactcacctctcgggtctcagtttgaggctcatttcctaggggagacataggtgccctgacctttcaaactaggtaagctcctttagggtccagctgcaacctcatctcttctggagcgcttgcttccctctacatatttagtttcttttaaattgtaagaataactatttagttcccacctatgaaatgaagttgtaccatttaattaaaggtgatgaaaatattcctgaactgtagaaaatgtaatcataagcttgtaaacatgaaaagtactttgagtacactattgatttaggtgcttttatggagttacggtcccttttaagaatctgctgaatgctacggactccagaataatgctcatttgcaagtacattgtatactttttcaaaattcacagaaaaggctgggtacggtggctcacatctgtaatcccagcactttgggaggccaaggcaggcagatcacttgaggccaggagttccagaccagcctggccaacacagtgaaaccccatccctactaaaaatacaaaaaactagctggacgtggtggtgcatgcctgtaattccagctacttgggaggctgaggcaggaggattgcttgaacctgggaggcagaggtagcagtgagccgagattgcgctactgcactccagcctgggcgacagagtgagaccctgtctcaagaccaaaaaaaagaaagaagaaaaaaagattcacagacaagtattaaaaaacgtcatgtggagagtagtgcacaaacgtcatctttctcttgccctctcaactctttaagactgatttatgctcttaattctgtcgcttctctgttctacctcctagaatttagtcatcagcagcattctttcaccttttatcatctgtgttttctcctggaccttttctctcagcttatataatagataacaattcaaagtatatctttttccataacactttattctacttttgaataactttttttatttttattttttagagatgggagtcttgctatgttgcccatgctgttctcaaactcctgagctcaagtgatcctctaatcttggcctcatgaagtcctgggattacaggcatgagccactgtgcccaaccctgaataacttttttagtataaattatcagaaatagttaaaaaaatgaacattttttctggttcttttgctactcattgccatatttttctctctttttttttttttttgagacagggtctcactcctgtcacccaggttggagtgtagtagcgcaatcatggctcactgcagccttgatcttctgggttcaagggattctcccacctcagcctcctgagtagctgggactacaggtgcacatcaccacacccagctaaaatttttgcttgttttttgtagagacgggggtctccctgttgcccaggctggtctccaactcctggcctcaagtgatcctcccatctcagcctctaaatgtgctgagattacaggcgtgagccactgcgccttgcctccgtgacacttttcatttatttccttttcgtccgaagctttgtgtaggacatgacacttttccaaatgctttcctaggccaggtatggtggcttacgcctgtaatccctgcatgttgggaagctgaggcgggaggattgcttgaagccaggagtttgagatgggcttgggcaacataggagatcctatttgaaattaaaagaaacgaaacaggcagggcacggtggcctgtaatctcagcactttaggaagcccaggcgggtggatcacatgaggtcaggagttcgagaccagctcaggaggctgaggcaggagaattgcttgaacctgggaggtggaggttacagtgagctgagattatgccactgcattccagcctgggtggcacagcgagactctgtctcaaaaacaaacaaacagtcattatttaatgtccagctccatgagggcaggggctgtgtccatcttgttcactgctaatatcccccatgccaagcacagtgcctgattt[133 bp omitted]cctgtctctactaaaaatacagaaattagctgggtgtggtggtgcacgtctgtagtcccagctactcgggaggctgaggcaggagaattgcttgaacctgggaggcggaggttgcaatgagccaagatcgcgccactgcactccagcctagacaacagagcaagactctgtctcaaaaaaaaaaaaaaagaatatctttaaatggattaatgaatgtgaataaaaaccactaacccagaatttattcttgcatctgtttcgtgggattagcccaaattctagccatatcaataaaaatttactaatcatttggcctaactggcctcccggcctcgtgttccatctcccttgtgagccatcctatagccgcaaccacagtaacactaaaacaaacaaacaaacaaaaaaacccaagtctgattgtgttctcttcccaaacctctgctatctcccccgctgcctacagaatacagtcaacgctcctcagcttggattcaaggctttggccccaatctccctttttaaacctctctaggcttatttattaagtgcttattatatgccaagcactaggctagtcactgagttcataaaccagttggagagacaggtacattgactaattttaataaggtgtgatcagcactattacagagactgtgagaacacagatagtttcaggtaatggatgataaaatattgtttttgacctctgcaggttcacgagttctgtctacaatagtaatgtccaatacagtggtcagacacatttcaagtgctcaatagccacctggggctagtgtctgtcacactggatagctgagcacagatacttttatcacccatggacgtgggggttaactatagctgcttccaagacagcaagggagccgggctcggtggctcacacctgtaatcccagcactttgggaggc[137 bp omitted]cgggaggctgaggcaggggaatcgcttgaaccggggaggcggaggttgcagtgagctgagatcgcgccactgcactctagcctgggcaagagagcgagactccgtctcaaaaacaaataaataaataaataaccaagacagcaaggaacatttcccatatgtgaagcctgtggtgctagctaccagttccccaaacacaacccctctccccaacaccttggctcgggtatattttgtagtacaggctcccaagagaaagaatgcatgaaagtactttgtaaactattaagtgatacagaaatgtgatataataaacaggctcagaggtcttgctttcatcatggctttggttacttcgagcaaattatagctcttttctcaaactactcccacccctataatttatgccaaagtgttctgaaaagaaacacaggcaaaatggttatcctagggctaaaaatcctgattatacctaccttgaagcttttaatccaggaccctacttcaccacccgcctgctctgtcactttctctacaaaggaaggacacgaagtaagacttccaaaagaacaaaacgtttattttttaaatttaagaattatgggaaacctaagtaatgggaattgcatcctcatcggggtcttctggcaagtcggaagcaccaccctctcctgtagctcgatgcttctctagtttagcaatcaattctttcgctggattgaagacgccattggtctgctggtcacagacatagcagcgcggggtggtgcggaaatgctgcagtgcacagctctcgcagaaataatgcctgcacttggtgacaactgggttttggaagctctggcgacagatgaaacacttgaatggtatttcctcatcatcgcttcccacttcatagttttcatcctcatagacaccatagcgaccctcatcaagctcacgttcgatctgccacccatgcttgtaatctgaacggtcatggaggaatttgcagctgtctccgaagccgcagaagccagtctctttgtagtccttacagatgtcgggctggtaatcccagcgcacggtggcacgtagatgctcgggcgctcggatggggcccttcctcaccatcccggaagaggcattgcccatagacgtatccttgggcttcatgtatttctgataattgttgattccccgatagatcttgtcatcctccttgcccctcagctcctcctggatcttctggctgcgctcaaagatggcttgtgcatcgcgctctttctctgtgtccagctcatagacagctgtcgctcccatatcctctggtcccacgggtttcgccgaacgggtggatttataaaccacgccgagactctcgggctcattttcctcttcctcttcgctgctcaagtcgccgtaagccgccttctgtttaccactgtcacgggtcttctgtatcattggattgtgggtcacccgcttcttttccggtcgaaccacagtgcagccttcgtcgctactgctgccgctttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggtaagccggcttcggcccgggggccgactccacgggctgatttccgaaaagggtggtgggcagggagaccgtcagcctgcgaaccctctctccgaggtcggccctctacttgcttccggttgcctagaagccgaggcttgcgaaacgaagcccgatagaaactacatcctgctctagtgaaaaacagcgtttctgggtgtatcagagtgggccttagggcagagtagcgacgcgggggccgggaaggtagattagaaaaggtggctcaagcctgagaatcgctcactgcaacctccgccttctgggttcaagagattctcctggttgggcgcggtggatcacgcctgtaatcccagcactttgggagaccgaggcgagcggatcacctgaggtcgggagttcgataccagcctgaccaacatggagaaaccccgtctctcctaaaaatacaaaattagctgggcgtggtggcgcatgcctgtaatcccagctactcgggaggctgaggcaggagaatcacttgaacccaggaggcggaggttgcgatgagccgagatcgcgccactgcactccagcctgggcaacaagagcgaaactccgtctcaaaaaaaaataaataaagaaagaaattttcctgcttcagcctcccgagtagccgggaccacgcctggctttttttttttttttgtagaggcggggtttcatcatgtt[132 bp omitted]cctttaggaatttactgcgagatcttgtttttttacatcaggattcattttcccctcttcctagtccttcacatcatctcaagagtacaggatataaatttatttactttttgattttgttattgttcttcacgtgtgatctacagctgttgtttcttagtgtcccaaaagacaacaactagatatttctttttttttttttttaaaaaaaaaggaaaaaaaattcatgttggttaaaatagtgtaaaaagtcacaggtaccaacttaatcctaaagtttagtggtctgattttatttaggagattctgttctttgtactactaatttgcatttttatttaaacgatgattccatttctctggaatgtcccttttaaaaattgtagtatctatcaattgggtcactcacttttataaactgcaacaataattgtctcttatttgaaggaaaaaagggttgctcattttgggtatcactggagtctgatggaaagagataggcgcatctctggagttgatcgttactatgtgtcaaaggtaagatgccactctgatgccagccttttgccagggttgaggtgggttctggtaatgccttgccaagggtcatacagtgctaatatataactagcattttcttatctactagtgaggttggcatctttttacatatttaatcttttatatttcttttttttttttagtttttcttctgtcatatatttcttattctgtggattgttgcctatatcctttgcctgttccattgtctttttctttttgagctatggttctttatatattctagactttaatttttttgtctattttatatatgacatttttcccagtctgctgtttgtcttttttactttatgatgtttttcatcaggtagttctaaattttgatattcaatgtatcatgttttgttgttctggattctaggtttttatgtctcccgtacaaaggccttttctatctaagattataaaaatactttcaaaaaataaaatagagacagtcttgctgtgttgcccaggctggccctcaaactcataggctcaagtgatcttcttgcctcagccttcggaggagctgggactgcaggtgtgccactatacctggctcataaaaatacttttaaaaaataatttctcctaatattgttagtttctttaaaaaattagttatttggttacatctacaggtcattttggagtataatgtgaaaggaggattaactttacttttttccaacaggtagctagttatcgcaattacccatttatagaagagtttagtagtcctagctactcagaaggctgaggcaggaggacagcttgagcccaggggtttgaggctccagtgaactaggatcgtaccactgcactccagcccgggcgagagaatgagagcctgtctcaaaaaaaaaaaaaaaaaaaaccaccaagcacccaatttatttttatttgtaataccactctggtaaactaaatttccatgtacacatgggcctgtttcacggatgtgcttttctatactctaggtctgcctattcctgcaacaatacttcatttaaagaattactataattttatattttgattcaattatgacattgccatttttgtaggtcaaaaacgaccaagcagtagcatttcataaggctcaacttaatagtatattttttgtttttctgtctttttttttgttttttgagacaaggtctcacgctgtcactcagtctggagtgcagtggtgcaatcttggctcactgcaacccccgcctcccgggttcaagcgattcttgtgcctcagcctcctgagtagctgggattacaggcacctgccaccatgcccagctaaatttttttttgtactttttggtagagatggagtttcaccatgttggccaggctggtttcctaactcctgacctcaagtgatccgcccacctcaacctcccaaagtgttaggattacaggcgtgagcccctactcctggccctaatagtatgtttttatattttgtaggagtagttcattctcatacttcttttaaaaatgtttactttttaatattttctccttcctcatttattcctcacaacaaacctaagtaaatagtatttccattttatagacaagggtcagagtgattaagtaatattataaggactcaacctgggtgatacacctctcagtagagaggtagttgagaatctaatccaatgaacatgataatagatatctacttatctggagccatatttctcaaagtatggtccaagaataaccatcagaatcacctagcatgtgagacagaattaggatttctaagagatggctccaaggaagatacagttttaacttctcttaaggcagttcttcctgtaatagtaaaccaaatacctggactatgttatttaatacctagaagaagtgtcatcactgatgagtctttttttttttttttttttttttttgagacggagtcttgctctgtcgcctaggccggagtgcagtggaatgatcttggctcactgcaagctccacccaccaggttcaagcaattctcctgcctcagcctcacgagtagctgggattacaggtgcgctgtaatttttgtacttttagtagagacagggttt[142 bp omitted]acttagtaagatccagtaggtattttgaatagatagtgtagtgcttgtcagagaagggttcgggagttggggtccctgaattctggctctgctaattccttatggacttaagcaggtgacttttaacctctctgagcctccatttcctcatttgtaaaaaaaatggaatgagaataatagtatctacctcatgttggctgttattttttaaaacagattttaccttcttgtcctctgactcactgaggtgctttgtaaaaggatccaggtggaggccaggcatagtggctcacacctgtaatcctagcactttgggaggccgaggcaggtggatcccctgaggtcgggagttctagaccagcttggccaacatggcgaaaccccttctctactaaaaatacaaaaatcagctgggcatggtggcacatgcctttaatcctagctacttgggaggctgaggaaggagaattgcttgaacctgggagatgcaggttgcagtgaggcaagatcgcatcactgcactccagcctgcatgacgggagtgagactccatctcaaaaaaaaaaaaaaaggatccaggtggtaaagagttgcttgactttagttctgattgggggtcggggaaggtttgtttcatataaagcaatatgctgctgtcagaaaatgaaaactagaaatcattacaggttattctttagtgattataaaatttaatccaatgtattgttgcagttagagaaatgtgggatgtggaagcactctttttaataacaatgccatttaatgacactggaaataaaagtacatggcatatctttgatgggaacagacttgtcacattctcctttttaaactgtttttcagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaatgcatttcttttttttaaatatgttacacaaaatcaagcaatctacccaatgtagtctttatcacttaaaaaaaactagaaggcaactgtgaggcttgtatagacataatgtacatccataatgtacatcaagcacctgtctctgtgcctagcagctaatacttcataaattgtagttgctactattgtaatagacactagtatattttatttaactttatttatttatttttttagacagagtcttgctctgttgcccaggctggagttcagtggctcaatctcggctcattgcaacctccgactcccaagttcaagtgattctcctgcctcagcctcctgagtagctgggattacaggcacctgccactgcacctggctaatttttatatttttaatagagacggggtt[132 bp omitted]ttcaccatgttggccaggctggtctcgaattcctgacctcaagtgatccacccaccttggcatcccaaagtgctgggattacaggtgtgagccattttgcccggctgatattagtaaattttacaaacatagtttcttcagagatgaccaggggaatacagaaaaagtattttttttctagttccttttctgagtggatcctacaatgtttaaaattccagttggttaggtttgagctgagaggggtgtaagaagataattccaggccgggcgcagtggtggtgtgagacaggagaatggtttgaaaccgggaggtggaggttgccgtgagctgagattgtgccactgcactccagcctgggtgacagtgacagagtgagactccgtctccaaaaaaaaaaaaaaaaaaaattccagttgggatatgtttaaaacggattgcaccttcaaccttcatacattctgtatagtatctaacaaatagtatatgcttaagttaatttttgttttagtatacagcaacagcaatcattcggtttattaaaatgagagtgtactgagcacttgaaatagagatgcatgttcaacattaaaggtaaccaaagatgaagatctgaaaagataaaactaaagatggtgataactccatgtgtataaagcaacaccacagatgacacttccaggtgagaatactaagttgcttttcattgcttatccagtttaacatttgatctggttaccttgaacatgcctgcactgtgtgattgccattgatctaattttatagggcggggcttatagaaggaagtggtgtttaaacttacagtggtggctggattgtgccatcccttgatcggcaatgaccttttactttttactgtataaggaaagcctggtcatgattacaaacttaatagaacctgtattatcatttaatgcttcacaggccttgtgtaattgactgttaggagaactatcgccggccgggcggtggctcacacctgtaattccagcactttgggaggcgggtggatcacctgacatcgggagttcaagacctgactgatcaacatagagaaaccccgtccctactaaaattaacaaaactagctgggtatggtggcgcatgccggtaatcccagctactctggaggctgaggcaggagaattgcttgaacccaggaggcaggggttgcagtgagctgagattgcgccaccgccactccagcctgggcaacaagagtgaaattctgtctcaaaaaaaacaaaaaacaaacaaaaaagctatccctggaaaggaaggaagagggcaagtagtacacctagggagttgtggatacagaagatgtgttgaaaacatgacttatctattactacttttattgatttttaggtctgttatttctccattttgcctgtaggcagggatcatcccctacatttttatgtccttagacgactgtcacagctacacagctgtatagtgaggggctacaaaatgacaggtagagttggttaggttcacggttaagagtccaaattcttcactgcccttttttgtagcatctgctgtgaaattgagctttatttttgtactctactgctagggggtgagccagattaaagcactttgaagatagaagatttaacggtggatttcttttattttttcttttcttttttttttttttctgcaagtgcaattagaagggttttcttaagcagctctaactgatgtggtaaagctactgatgtcagatccatctgtcaccagctcttaaggcctgttaaaatgctgcttaggaaactatcccatttgctcggttttatttactatcattaagtttttaaaaaatagatgttatattcacctagctcaaaatccaacaatatgaggtatgcagtgaaaatagttgctctaatcccctgcccaacacctgtcaattgtcacaccaccccaaagggtttcttttttttatttttttgagatggtgttttcgctcttgtcacccagactggagtgcaatggcgtgatctcagctcactgcaacctccgcctcctgggttcaagcaattttcctgcctcagcctcccaagtagctgggattacaggtgcccgccaccacactcagctagtttttgtatttttagtagataaggggtttcaccatgttggccaggctggcctcgaactcctgacctcaggtgatccacctgccttggcctcccaaagtgctgggattacagctgtgagccactgcgcctggcgtgggtttctttttactttaaaaataatcctttttggctgggcatggtggctcaaaaaaaaaatccttttttattaaacccaaaccaaaaatggtcaatagtgtttctttttctttttttctttttttcgagacagggtctcactttgtcacccaggctggagtgcagtagcaagatcttagctcactgcaaccactgcttcctgggctcaagtgatcctcccacctcagcctcctgagtagctgggaccacagcaggcacttaccaccacgcctggctaattgtattttttgtagagacagggttttgccatattgcccaggctggtttcgaactcctgggctcaagagatctgccagcctcggcctcccaaagtgttgggattacaggtatgagccaccgtacctggccaatagggtttctttttgcacatacaaatacaaacgggttcttctgtcttgtatgcaattgtagtatctgacacatactgttcacttctttggaagtttggaataatggttcttgtttgaaattacatgtaccaggttgttacttgtagggtcaaataaagtagtcaataggaaaagactgaaaaaagatagaggaagccacacatattcagaaggaagaggaagacaatggcgttgccttttgtttgggaaccaaatgatcacttagccagtggcagagctgggactagaatcctgatgttttgactcccaacctagtgtattgttctttgtggtttacttcactaaacactgattgagtaaatgctacatgccaggtgctgtacctcagatttgaatatgacaccacaggccggatgtggtagttcacccctgtaatcccaacactttgggaggctgaggcgggcagatcacttgaggccaggagttcgagaccagcctggccaacatagcgaaacccccatctctaccaaaaaataaaatgacctaaaataaatgaatgtgacacagaattgctctgcaggaactcagtcagtgggagtgacagacaactatgtgaaggataagtgctgtgacagaagtttgcagaaggtgctgtgggagcgcagaagtggggcaacccagccttgggttgaggggaaaggaaagagcttagggatacgtttccagaggatgtctacactaagctgtctggaaggctggataggatttacgagacaaacaactgaggggaggacattccaagcagagggaacagcataagggtggggacacaaatagcatggctatgtgggaaactacaagcagttctgcagagcgaagagtgtgaggcagaagagagggaccagagaggttggcagggcccagaacgtgaatgtctccccctgggtgtcggaattcctcctgagggcgactgggaagtctagcaagaggtaggagagtgatgtgacttgcgcacatctgcctggctgctctgcacagtggttctcagctgggtgagtttgcctcccagggcatattgcaacgactgcagacatttttccttgaggcaacaggaggtatgggtggggaggtgttgctgacatctagtggttagaagccagtgatgcttctaaacatcctaagatgtacaggacagtcccacattgacagtttccagtagccttaagtgtcaatagtgccaaggttgagaaactctgaaaacagtagcaggttctccattaaggaacacagtgggaagtgttttttaaaaagattctgcctgggcacagtggttcacacttgtaatcctagcactttgggtggttgagacaggagaactgcttgagcccaggagttcaagaccagcctgggcaacacagcaaaactccttatctattttgaaaaaaagtattaaagagtccgggcgcagtggttcacacctgtaatcccagcactttgggaggccagagcgggccaatcacttgaggccaggagtttgagactagcctggccaacatggtgaaacctcatctctactaaaaatacaaaaattaggccaggcgtggtggctgacacctgtaatcccagcactttgagaggccgaggcaggcgggtcacctgaggtcaggagttcgagaccagcctggccaacatggtgaaaccccatctgtaccaaaagttacaaaaattagccggacgtggtggtgtgcatctgtaatcccggctacttgggaggctgaggcaggagaatcacttgaagccgggaggtgaaggttgcagtgagccgagatcaagccactgaactccatcctgggtgacagagggcgactctgtctcaaaaacaaacaaataaataaaaatacaaaaattgctgggtgttgtggtgggcacctataatcccagctactagaaaagctgcagcacaagactcacttgaacccaggaggcagaggttgcagtgaaccgagatggcgccactgcactccagcctgggtgacagagtgagactccctctcaaaaaaaaaaaaaaaaaaaaagcgttaaagagagaaaaaagttttaaaaagtcctaattattcagaaatgtatgggagcaatttcccttctccctccctctcctggttctttttttcattcagatctctgttggctcatctgtaaacttgaagcatatcccttccctggaggcgtttgtttttccaaggaagtatcctaatgtactcttctttctttctttttttttgttttgaggcggagttttgctcttgttgctcgggctggagtgcagtggcgcaatttcagctcactgcaacctccacccccggggttcagccagttctcctgcctcagcctcccgaatagctgggattacaggcatgtgcactacacccagttaattttttgtatttttagtagagacggtgtgtcaccatgttggccaggctggtctcgaactcctgacttcaggtgatccacctgccttggcctcccaaagtgctgggattacaggcataagccaccgtgcccagcctcccaatgtactctcagtgatgtgcctcagcttgagaaggcacagaacaacatgtttcttttccaaatagatgatgtaagatgtggagacacagaaagttgggagtaacttcacatcaggaagctgcaccacctgtgggttgtgtggcctttggtaggtcacatcactgatcttagcttcagttctcccatctctcaagtgaggacagtatgtgccctgcatacgtccctgggtagctgagaagatctcacgaaatcatgtatgtgaagtagtttctaagtgtacagcctcgtgcatgtggaatggaccattgctgcattttgagcacccctttaacagctctccagccaacccccaaatccctcaggcacttacacaaaagtgatgttgggaggaccctcaggccaggtctttggtcccctgttagagtggtcacagctagggaatctcagagcactgcaaggacaacagacggtaggaactttgatgaagacactaattgtttggaagctgttttctgaaagcagagctaaaaacgcagtttcatgccactgtgagaaccgagtgcctggttacccctctcagctcttgctgcttgctctgctctaagggaaggtgctgaatggataggactgaagctggccattctcaccaagaagcttctggttgagggtaagggatggaggatgagagttaaacatcagttggttttcaagagtccatatcactctgatacttctgtgaactgagaaattattctcctgtacttctgtgggaaacaaggcacatggtacaattttagggtttttttttttttctataccaagtgtatagatttggattttagatatcaaaagagactgtcattcagcttactggtttgggtctgtgtgtgcttgtgtaatgctccctctgtcacctcatccataccctcctgaccaaatattttatctttgaggtttgaatactctagaatttttttttttttttgagatggaatctcactctgtcacccaggctggagtgcaatggcatgagtggtggagtgcttggctcactgcaacttctgcctcctgggttcaagtggttctcctgcctc[133 bp omitted]cggcctcccaaagtgctagggttacagacgtgagccaccacacatggccaattgtcacattttgatgcagttttgataaaaggcagagagaaagaaattcctataaagaataaatcctgtgttacgtttgcataatctttaattgttaagtttttttggcatatttctgtaccctatatgtcttatgctattgtctgtaatactccttcctccaaccccaaagactcttctgcaacaaaaatccaaataattgcttttaggatttccacaaatcttgattcaccattagacacataattgttctttacagggaaccactgagaaaatgacccagcagatattacttgtataaactcaagtaactgttgctttattcgtttgaacacatttggtatcatccattgttttggttcttcgtaggtgccttcctcagttcgagcaaacatggagagaccaattattatatttgggctggagagtgatcaggcaataaaacttataaacaaccatgcaattttaattatgaccccaaaaaactaatcccaaaggcaacagaaagaaggtagggaaaacactgggaacactgagcattactgccccaagaaaacaaagat[133 bp omitted]gaaaccccgtctctactaaaaatacaaaattagccgggtgtggtggtgcatgcctgtaatcccagctactcgggaggctgagacaggagaattgcttgaacctgggaggcggaggttgcggtgagctgagattgtgccattgcactccagcctgggcaacaagagtgagactccgtctcaaaaaacaaaacaaaacaccaccaccaaaaaaaccccaaccaaacaaaaaaacacagtttctttggtatactgtgcctatctgctctgtaccacctgccatgttgctggggagtgtttcattcagcagacagattttccctctaagcctaatacgcttcatttctagaggccagaagtcaccccggctaccagaagcttgttcttctctcttacctctaagaacttagtatttggggtggggttggtctggtctctagggaaactctggagttttcatacagtgcctacaagagcagcccactctagttatgaccgtggatctgaacatcaagacatcactatcaaaaatccagccattggattataaatcatgctgctataaagacacatgcacacgtatgtttattgcggcactattcacaatagcaaagacttggaaccaacccaaatgtccatcaatgatagactggattaagaaaatgtggcacatatacaccatggaatactgtgcagccataaaaaaggatgagttcatgtcctttgtagggacatggatgaagctggaaaccatcattctcagcaaactattgcaaggacagaaaaccaaacatcgcatgttctcactcataggtgggaattggacaatgagatcacttggacacagggtagggaacatcacacactggggcctctcgtggggtggggggaggggggagggatagcattaggagatatacctaatgtaaatgacaagttaatgggtgcagcacaccaacatggcacatgtacatatacgtaacaaacctgcacgttgtgcacatgtaccctagaacttaaagtatatatatatatatatttaaaaatccagccatcaggaacagctttgccatagtacttttgttctgaggaaggcactattcaatgaggcactcatgctcaaggatggccaggatattctgagaggttttcgtgacatcatgactctcaaggacctacccacctgggcctgactaccacagtactcaggtctgtggcctttactgttagaggatgggcttctgcttgggaaaggccctgggttcctaccacctcctccctctttcttcctagggcagtctggtggcctttgagacatgaagcaaagtcacttgcttagaactgaggcaggagaatagagtctggaagcagggaacctaaggccatttcatgctgacttcctagaactaaattgaaaggaaagccctacctttccacgcctacgtaacaaaagaaccagaggttgctccccttgcaaatccccacctttctgtgtggcagatgggaaattgaaagtacctctgattggttggaaaaaaagcagatggcaaattgaaagtacctctgattggtcgctttttgcaaccaatcagacgtttgcataggagtgtaactttgtaacttcacttcaacctctgattggttgctatcctaaccaatcatacggattgggggccaagtcttcgtttgtatagaagggcaactttcactctagcctctgattggctgctttccacaaccaataagatgtttgcataggagtgtgacctttgtaacttcatttcagcctctgattgtgggctgcaacttcatgaacatggggtgaacaccaagtggccaatggtaaacctctagcgggtatttggaccccagaagattgtgtatcagggcccttgagccactgctccgcccgttctcacactgtggagtatactttcactttcaataaatctgtgcatgcttgcttctttctttcctgtctttgctgtgcgttttgtccaattctttgttcaaaacgccaagaacctggacaacttgcagtaaagaccctctactggtaacagaacctgcccaaatccaacatgcctcatgttttgggtaagaaagcatttcattgtcccctgctttgacttacttgctagttattttttcatgtgaacacactttgtcttcccaactatattgtaagtgcatcgagggtgggaaccttgtcttaagccagttttacttctcacaattcctgccacctgcgcactttacagtcacttaaaagatacgtggtggccgactgggttcattcgacaagcagagaatgtcagctttaagcctaggcttgtggctaagaggcatcagccttgctagggattggtaggataagagaaagaaggggaaaaaataagtaagggtagggttgaaagggtgagcatgagagtataaggggaggagagggaagaaactgagagggaatgaaaatgaggcataggtggaaaagagtataattcaaggcccagggtgtggagtcccaagagagagctctgtcctctcttccttgtgctgtgatgtagactacccctatc[136 bp omitted]caacatggtgaaaccctgtgtctactaaaaatacaaaaattagcagggtgtggtggtgcatgcctgtaatcccagctactcaggaggctgaagcaggagaatcgcttgaatccgggagggggaggttgcagtgagccaggatcgtgccattgcactccagcctaggcgacaagagcaagactctgtctcaaaagaaaaaaaaaaaaaaaaaagcagcagcagcagctaagagagtgtaggccaggcgcgatggctcatgcctgtaatcccagcagtttgggaggctggggcgggcggatcacttgtggtcaggagttcgagaccaatctggccaacatggtgaaatcccgtctctactgaaaatacaaaaattagctgggtgcggttgcacacacctgtaatcccagctacttgggaggctgagacaagagaatcgcttgaacccgggaggcagaggttgcagtgagccgagatcgcaccactgcactccagcctgggcgacacagtgagactccgactaaaaaaaaaaaaaaagtgtgtggatctgcaagactctccaaagcagttctctctagtgagcacaacatccttgatacaaatttccccctcccctccactccccacattcaggacaagggaggcgctggccctctcgccccctggcggtctgtctagctcccggcagcctcggaaagcccaggacagtagggcagtgtacttgcgaccgaccccgcccatcggctcctggggagctgacaggacgcactccacttggccaggcctgtatcaggctctggctctgtcgcccaggctgtaatgcagtggtgcgatcatggctactgcagcctcgacctcccgggctcaagtgatcttccatctcagcctcccaagtagctgagaccacaggagcgcgccgccacgcccggctaatttttgttactggggcggcgcgtattggtgcagtctccacgttctttcagaagaacgcgggcgcatcgctggaccacgcgccagtgggcagccggcgcagcctccctgccccccatagtcccgatgcttccagaggcccatggcgggggtgcggcgcgggggtggggagtcgggtgggagttatggcttcccaagcagccaagtctattttcttcccgaagagggaggggctgagcttggcaaggctctagccagctcctcccgctctgccccacctgctcctcccagctctcccctccatctctgcttccaagccatttttctccactcatacctgcactagcatccgagcagggagtagtttggaagaacttgtcctcggcgctgcatgaggattcaaaaggcctctcaacctagagagccctggaagccaaaatttgtgcgtttcagtaaggggcttggctgggggtaagaagtaaagttctggccacagaatttaagcttctgcttcaaagaaggagcctttctaatctgctgggaaatctctccaggttccctccacgaaagtattttgcctgcatttgtctcctctgggcaggcaataaggaatcctactcccagcccgttggggtggcttacgcctgtaatcctagcactttgggaggctgaggcaggaggatcgcttgaggtcaggagtttgagaccagcctgggtaacatagtgagacctagtctctacaaaaaattagctgaccttagtggtgtgtgcttgtggtctctgctacttgggaggctgaggcgggaggatcagttgagtccaggaggtggaagctgcagtgaaccgtaatcgcaccactgcactccagcctgggtgacagagtgagaccctatctctcccctccccccaccaaaagaaaaatgtaaacaaaacaaaggggaaaaaaacaaatcctggccctgcgtggtagctcgcacctgtaatcccggcactttggaaggctgaggctggcggatcccttgaactcaggagttcaagaccagcctgggaaacatagcaaaaacccgtccccacaaaaaaatacaataattagctgggcatggtggcgggcgcctataatcccagccactcaagaggctgaggcaataagattgaaattccatctcaaaataaaattaaaataaggccgggcgtggtggctcacacctgtaatcccagcactttggaaggccg[135 bp omitted]gaggcaggagaattgcttgaacccgggaggaggaggttgcagtgagccgagatggcgccgctgcactccagcctgggtgacagagtgaaactccatctcaaacaaaacaaaacaaaacaaaaaaacgaaaaaagaaaaaagaaagaatcccactccccttcccacatcaggtcctcaccaccatgttcttctcaccagtggcctctggggtgcctaggagaggtcttgctgtccttgcccacctaagctcgacacgaaggaaacgggagctctgctttacacaatgcagctactgtggggcctgtttctaacccccatcccagaagcagcacaactcccccaccctgaacccaggaggagggcagggctgtggttcctggcctgttgtggcaccagagggttaaagacagttggtgtgatgggctttctgggaatcagaccggtgagcagaaccgagggcagtcaccatcgtcaatcacagctccggagcttatgtgctcaacaacaacaacatccacacaaatcctcttatttatttattgagatggagttttgctcttgccgccaaggctggagtgcaatggcgcgatccggctcactgcaacctttgcctcctgggttaaagcgattctcctgtctccgcctcctgagtagctgggattacaggtgcccgccaccatgcccggctaatttttgtattttcagtagagacggggt[131 bp omitted]cttccgggcactgaccctaccacatgagagctcaggacacactggtccctggagtactgggctaattctcccagctcagcagagtggtgggctcttcccggttcctctgcttttggagtctgtgctggtcattgagaggtgacagcgtgctggcagtcctcacagccctcgctcgctctccgcgcctcctctgcctgggctcccacttcggcggcacttgaggaggccttcagcccaccactgcactgtgggagcccctttctgggctggccaaggcaggagccggctccagggaggtgtggagggagaggcgccagcgggaaccggggctgcgcgcagcgcttgcgggccagctggagttccgggtgggcgtgggcttggcgggccccgcactcggagcagccggccggccctgccggccccgggcaatgaggggtttagcacccgggccagcggctgcggagagtgtactgggtcccccagcaatgccggcccaccggcgctgcgctggatttctcacttggccttagctgccttcccgcggggcagggctcacgacctgcaactcgccatgcctgagcctcccaccctctccgtgggctcctgtgcggcccgagcctctccgacgagcgccgccccctgctccacggcgctcagtccgatcaaccacccaagggctgaggagtgcgggcgcacgcgcaggactggcaggcagctccacctgcagccctggtgtgggatccactgggtgaagccagctgggctcctgtgtctggtggggaggtggagaacctttatgtctagctcagggattgtaaatacaccaatcggcgctctgtatctagctcaaggtttgtaaacacaccaatcagcaccctgtgtctagctcagggtttgtgaatgcaccaatcgacactctgtatctagctactctggtggggacttggagaacctttgtgtggacactctgtatctagctaatctggtggggacttggagaacctttatgtctagctcagggattgtaaacgcaccaatcagcgccctatcaaaacagaccactcggccctaccaattagcaggatgtgggtggggccagataagagaataaaagcaggctgcgggagctagcagcagcagcaacctgctgaggttctcttccacaatgtggaggtgttgttcttttggtctttgcaataaatcctgctaccggccactctttggatccacactgcctttatgagctgtaacactcactgtgaaggtctgtagcttcactcttgaagcttagcaggaccacgagtccaccgggaggaatgaacaactccagactagccgccttaaaagctgtaacgctaactgcgaaggtctgcagcttcactcctgagccagcgagaccacgaacccaccagatggaagaaactccgaacacatccgaacatcggaaggaacaaactccagacgtgccaccttaaaagctgtaacactcaccaagagggtccgcggcttcattcttgaagtcagaccaagaacccactaattccaggcccagtcagtcttaccatcatcatgatacgttaactaatgtttattgagcatgtacaatgtatctgtccttgttttgaggtctctgtttgaatcacctaaattcatctttttaccaaccctataaaaagcctattaagatccccattgtgcacatgagactcagagaggtaaaactatggaatgagaccactgcttctcctgttgtccttcttagcttctcccccacctcccctttgccctagtttatgagacaggagaaaagggagaaagcaaaaagttggaaagaaacagaagtaagataaatagctagacgatcctggcgccagcacctgggtggtggttaaaataataacaccagtagttttggtcaggggttatctgtgaattccagacattgtatgagaaagcactgtaaaaccttttgttctgttacctgatgtatgtagcccccagtcacgttcctcacgcttacttgatctattatgactctttcacgtagactccttagagttgtaaggccttaaaagggctaggaatttctttttcggggagctcggctcttaagacgtgagtctgccgacgctcccagacaaataaaaaacctcttccttctttaatccggtgtctgaggagttttgtctgcgactcatcctactacaaaacaacctgcctgaagtcacagttacaacgccagtatgtggcagagctcggatttgaaaccctgtactgtatctgcattcagagtctgtgttgtttcttttttttcctttgtgacagagtttcgctcttgttgcctgggctggagtacaatagcacaatcttggctcactgcaacctctgcttcccaggttcaagcgattctcctgcctcagcctcccaagtagctgcgattacaggccagcaccaccatgcctggctaatttttgtatttttagaagaaatgggttttcaccacg[136 bp omitted]aaactcctcccttcccaccctccattcccctgcctcaccactccacctccacagcatgatctctgggtgtgggacctcaaaacatgtgatgtcttccaggcagtgagctcagcatttcttcctggataaagacacttaacattgcagttttcttcctttgttgggtttgaaatccactgtcttttttttttctttgagccggagtttcgctcttttcgcccaggctggagtgcagtggcgagatctcggttcactgcaacctccacatctccggttcaggtgattctcctgcctctgcctcccaagtagctgggattacaggcgcctgccaccatgcccagctactttttagtagagacggggtttcactgtg[133 bp omitted]gatatctacgctgggcatggtgggtcatgcctgtaatcccagcactttgagaggtggaggtgggagcctaggagttcaagaccagcccaggcaacaaatagagaccttgtctcaacaaaacaaacaaacaaacaacaaactgggtgtagtggcacatgcccgtgggcccagctacccaggaggttgagttgggaggatcacttgagcctgggaggttgaggctgcagtgagccttgatcacaccattgcactccaggctgggaaacattttgagatcctgtctcaaaaaaaaaaaaaaagaaagaaagaaaaagaaaggctgggcacagtggctcacacctgtaatcccagcagtttgggaggccaaggtgggcggatcacctgaggtcaggagtttgagaccaaaaattatttgggcgtggtggcaggtgcctgtaatcccagctactcaggaggctgaggcaggagaatcgcttgaacctgggaggcggaggttgc[135 bp omitted]ttatagagagagattatgatgtaccaggcattgttcttggtcttcacatgaattgcctggtttgatccccataaaatccctattctgtaggcattgttattaaccccattttatagacaagggaactgagaaagaaaaatgttaaattgttcctgagtgtaagctgataagcactatatctctttcatctttgattcataaaagacatctttgaaagctgtaaaaggaaaataaaaacttgggaccccaattcactctgccaaaaggaaaaaaaattaaactgaaagctgagtcatgcaagaagctgcctttccttttgttcctaagcagacagctacaaataacaggttaaatatctccacctgtagctactctatgtttaccttatcttatgtaaagtgctgatttactgagcaggagacggatacataattgattcttcctctacctgctctttttctcttgcaacatgtggattcaatcatgtgaccataccttccctctcttccctcaagctcgcatttcccctttattattattatttattattattattattgttattatttgagacggagtctagctcttgttgcccaggttggagtgcagtggtgcaatcttggctcactgcaacctctacttcccgggttcaagcgattctcctgcctcagcctcccaagtagctgggattacaggtgccccccaccatgcccagctaatttttgtatttttggtagagacagggtttcaccatattggccaggctggtctccaactcctgatctcaggtgatctgcctgccttggtctcccaaagtgctgggattacaagcgtgagccactgcacctgcccttgcatttctcctttaaatactgaagcctaggccgggcgtgatggctcaggcctgtaatcccagcaccatcagaggccgaggtgcatggatcgcctaaggtcaagagttcgagaccagcctgaccaacatggtgaaatcccgtctctattaaaaatacaaacactagctgggtgtggtggcaggagcctgtaatcccagctacttgggaggctgaggcagcagaatcgcttgaacccgggaggcagaggtggcagtgagccaagatcgtgccattgcactccagcctgggcaacaagagtgaaactccatctcaaacaaacaaactaaaacctgaagcctggccaggtggggtggctcatggctgtaatcccagcactttgggaggctggggcaggaggatagcttgagctcaggagttcgagaccagcctgggcaacagagcgagaccttgtctctacaaataatttaaaaattggccaggtgtggtggtggcacacctatagtcccagctacctgggaggctgaggtgggagaatcacttgagcccaggcagtggaggctggggtgagccatgactgtgccactgcatttcagcctgggtgacagtgagaccctgtctttaaataaataaataaatactgaagccctcaaagtcatctttggagaaaggcacagacctgtctcccagacacatccttaaccttggcaaaataaactggtaaattgagacctgtttcagatactttttggtttgcaaagcaatgaagtacacatgggaagtcctaacctcagaatttggaaatgaaaaagtaaaagctcagccaaagaagtcagctttgggtgtgagtttgggacagtactttctgtacctcagtctgttcaactgcaatatgcaaatactaatacctcataatgctattgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctaggtatagctactacagtttggtcctattattgcggtcagacagttgctgtgattggctctcccctccttccctcaccccctcccatcttaccctctgttattaacataagcagtcagaaacatgtaggctatgcttcccattggttgaaattgttgtttccttggcagcacttgcaaacattccatctggcaatctgagagaagctactgagagaatcctgagacatccccagccacctaccactgctcctgttccaagcaaagaagatctgctcactccggtactggggattctccggggtgggggagtccacagaaaggacttgcagtggttctccctattcatcacccagaccccaaacgttaccattccccccatctcttcctacccaccctgcctatctggcctctgagaaggggaggggaggagaggggaggggaggggaggggaggacaagggagagggagggggaggggaggggagcggaggggaggggagaggaggggagggaagggaagaaaaataactaggagatgccagtgggagggaggcttaagaatggtgtgggcccacagacgtgtgagggtaaaaattgagcttcttcctgggcactgctccccatcttccctctcctgttggagcacaggctccccagggaaagtcttaaggaggtccttccatgcataaagcacacaccccatgtgcttcgtgttggaggtcacagatttgacttctcatcgatttatcaataggaaatttgctgaaagcaaagttac[139 bp omitted]ggtttcaagtgattctcctgcctcagcctcccgagtagctgggacgacaggcatgcaccaccatgcctggctaatttttgtatttttagtagagacgggattttgccatgttggccaggctggtttcgaactcctgacctcaggtaatcctcccacattggccttccaaagtgctgggattacaggtgtgagccaccgcgcccggccccaaatggacaattttctttctttcttttcttctttccttctttctctctttctttcttttcttttttgaggtggagttgcactctgttgcccaggctggagtgaagtggtgagatcttggctcactgcaaactctgcctcccggattcatgccattctcctgcctc[175 bp omitted]cccggcccaaatggacaattttctaaaggatcaagttgatatatggctacctcaccaaagtctactgaaattaccaatttacccaaaaacctttgtacagttgtctttaactacagagtttatagcaggttgctctggccaaattggcatggcctaagtaagggctagggagagccagttctctagtgttaaggacctttaggctcctcactgaccaccctttagcctctggctgctctggagtgggcaacctggaaatgctctgtgtgctctggcagatgatcctgtctacctccagctgcagcaacaaggaactggggcagaggcaaactgagcttaaaaatgccaacatcagtctgggcaacatactgagacctataaaataaatagcctggtgtaggcaggacacggtggctcatgcctgtaatcccagcattttgggaggccgaggtgggcagatcacccgaggtcaggggttgaagaccagcctggccaacatggtaaaaccctgtctctattaaaaatacaaaaattagctgggcatatttttgtatttacaatacttttgtattttgtatttacacacctgtaatcccagctactcaggaggctgaggcaggagaattgcttgaacccaggaggcggacgttgcagtgagccgagattgcgccaccgcactccagcctgggtgacagagtgagactctgtatcaaaagaaaaaaataatagccagctgtggtggtataggcctttaggcccaactactcaggaggctgaggtgggaggatcacttgagcccaggaagttgaggctgcagctagctgtgattgcgccactgtactccagcccaggtaacagagcaagactctatctcaagaggaaaaaaaggaaaacaaaaagctaaaatgaacaatagccaacattatttcagggatgttcaaaggctgtcccagtggttcttgaactgatggccgttggagccaggttgccttttgcagtatctactaccccctgggatcaatgatgatgtcaagaaaggaaacagagagttgccctttgtccgggcgtggtggctcacacctgtaatcccagcactttggagattacaccaaggcaggtgtatcacctgaggtcaggagttcaagaccagcctggccaacatggtgaaaccccatctctactaaaaataacaaaaactagccgggcatggtggcggacacctgtaatcccagctacttgggaggctgaggcaggagaatcacttgaacccaggaggcagaggttgcagtgagccgagatttcgccattgcactccggcctgggcaataagagtgaaaactccgtcttgaaaaaaaaaaaaaagagttgccttttgtgaaagaggctcccagagagagagtgggtcactggactctagatgaaaatgtgagaataaggccaggcgcgatggctcacacctgtaatcccagcactttgggagac[134 bp omitted]gaggcagcagaattgcttgaacccaggaggcggaggt[131 bp omitted]gagggagaagagcagcacagttgagagcatgggctgtgaagccagacactgtgggtgtacagctcagtttcctcattttcacatggcagcaacaggccctctgtctgtgactcagggctcctgtaggaaactgttggcatattaaaatgaggatagctgtagaagggttaagtaagggaatatttacaaaggtgtggccagattgcagggcaacagaggaaggtgcagctccccggggctagtaacagtgggcctaaaacgttgaggggagagaatgcttacccttaccacactgggaagctgggagagcgccaccctgaaagacgctggggacttcatgcagccagccatcagccaactcgcagggagaaaaccaccagggacatacattttgacttcctgatctccttattgtgtggaaccccctagaagccagagggcaccatttatgggtgcagtcaggttagttttccagggcaggaagcaggaggagatgcaaggacagtggatttggaaaggcaaatggaaggtgcccagcgcactctttcatagggctgtgatgacagttaaatgaaacatagcacattaaacacccccaaattgggagctgttatttatagaaaaatagctccatttggagagagatacccactttcatgtagcccttccactcaatggaaggattgcttgcaacatacttattttttattttttgagacagccttgctctgtcaccaggctggagtgcagcgacacaatctcggctcactgcaacctctgcctcccgggttcaagcaattctcctgcctcagcctcacgagtagctgggattacaggtgctggccaccatgccagtccaactttttttttttttgagatggagtctcactctcattgcccaggctggagtgcaatggcgtgatctgggctcaccacaacctccgcctcccagattcaagcgattctcctgcctcagcctcccgagtagctgggattacaggcacgtgccaccacacctggctaatttttgtatttttagtagagacggggttttgccttgttggccaggctggtcttgaactcctgacctcaggtgatccacccgcctcggcctcccaaagagctgggattacaggcatgagccaccaaacctggcccaggccaatttttgtatttttagtagagatggggtttctccatgttggccaggctagtctcaaactcctcacctcaggtgatctaaccccttggcctcccaaattgctgggattacaggcgtgtgccaccgtgcctggccatgttttttattttctctgagacagggtctcgctctgtcacccagactggagtacagtggtgagatcacggctccctgcagcctcgacctcccaggctcaagtgatcctcctacatcagccttgtgagtagaaagctgggattacaggcacacatcaccatacctggctaattttttaaacttttgtagagatggggccttgctatgttgtccaggctgatctcaatcccctgcacttaagcgatcctcccactttggcctcccgaagtgctgggattacaggcctgagccactgcacccggctgcctgtaaggaatttaaagctgtgctggaagtaagcaatttttcataagcaaagagacttaaacagtagcaagaaaagaaaggatttaagactcaagggaaaagatgtaaaaaacattgaaaatgaggaaagacttctagctctgtgatggagccatctttacagccctagtaacacaaattttcacattgtcaatacatgttaaaggcatctggaagattatagctatcatttatgataaaaatcttactagaacaggaacagacgaatgttttcttgatgtgatacatctcaaaccacaaaccagcatcatactaatggtgtaacaccagaaagcaaggccattaaagtcagacacaataggaggatgctcattatttccactttcattttacatttttctggaagtattaaccaaagctaatactcataagagatatatactcctggaaaaaagatgataaaagtgacagtttattggagatgatataattgtatactgtactggaaaaacccaagagagagaattatgaaaccaatattcctctgctgtaatgcctctactcattttaacactatctttataggccaggtgtggtggctcacacctgtaatcccagcactttgggagtccaaagtgggtggatcacttgaggtcaggagttcaagaccagcctggccaacatggtgaacccccgtctctactaaaactacaaaaaattagccaggcatggtggcacacgcctgtagtcccagctactcgggaggctgagacaggagaatcacttgaatccgggaggcggaggttgcagtgagccaagattgtgccattgcactccagcctgggcgacag[152 bp omitted]tctactgaaaatacaaaattagccgggcgtggtggcgcatgcctccaatcccagctactcgggaggctgaagcaggagaatcacttgaacctggattctcccgggaggcggaggttgcggtgagccgagatagcgccattgctctccagcctgggcaacaagaacaaaactctgactcaaacaaacaaacaaacaaacaaaaaacaaaacactgtctttatactttttttttttttttgagatgtagtctccctctgtagcccaggctggaaggctggagtgcagtggtgcgatctcggctcacagcaacctctgcctcctgggtcccggttcaagcaattctcctgcctcagcctcctgtgtagctgggattacaggcatgagccaccatgcccagctaatttttgtatttttagtagagacgaggtttcaccatg[137 bp omitted]gagatctcactatgttgcccaggctggtttcaaactcatagcctcaaactgtccccctgcttcagcctcctgaatagctgagattacaggcacatgccaccacacccacttcattttaacatcattttaaaagagccaggtgccctcagttgctcctagcagggattgggtttcttatcaaagattcaacttggaatcaatattgctaggcactccaaagaagtgctactttttttctactacattttgatttaagtcattatggtgttttttttgttttttgttttgtttttgagatggagttttgctcttgttgcccaggctggagtgcaatggcgcgatcttggctcactgcaacctccacctcccaggttcaagcaattgtcctgcctcagcctcccaagtagctgggattacaggcgcccgccaccacacccggcaaattttgcatttttagtagagacggggtttcaccatgttggtcaggctggtcttgaactcctgacctcaggtgatccgcccgcctcgggctctcaaagggctgggattacaggcgtgagccaccgcgccgggcctcattatgattttgagaatgtgagaatccttggttttcaggaaaagtagatagcagcagccaggcacaggtctgactcctacccttaaacccctaatcccctccctagaggcaataactgcttcctgtctcttgtgattcttcaagagatgatctgtacttatatgagtgcgttcacatgtgtgtacacacacaggcacacagtaacttctttttttccccaggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaaggtagtgatcctgtttgtttggatgcctaaataattgtctatatagtctaaatatagcaccacactacctggcaactaacgaactcacaccttttttttgcagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaagtttgaagtctggaaaatctaggagatggtatcaaagggggctgactagaataagtaaacatcatctccatctcagttccaaaatcaaggtgggatagtctttgaaggtgaaatgcacaatcacaatcattttccctgtgtctgtatcattctaaccttacatttccctgggaaaatctgctcttcctacttaagcaatttgtccatgctggtgcattaaatgggggcctagtggcctaaggagggagatgctcctccaaaataggagttctccaccaccattattttgtttattttttttagagacagggtcccactctgtcaccgaggctgcagtgcaggggctcgatcctagctccctgcagctttgaactcctgggctcaagcgatcttcccacctcagccttccaagtagacaggcacgtgtcaccacacctggctaatttttaatttttttttgtagagacagggtcgtgctatgttgctcaggttggcctcgaactcctggcctcaagggatcctcctgccttggcctcccaaagtgctgggattacaggtgtgagccattgcacccagcctccaccaccaactttagaatgctcctgttaacagaggggatgcagatggatcaaaagactttttgatttggctttggaatatattgcctgcatagtaagatgtacaatcccatgaattcctttgttcttctgcctgtgtctgactctgacttcttcgtgtggcagctttgctgagaaggccctggattactttgcataactggtgagtgaataaaggagaatggcttgggccaggcgcagtggttcacatctgtaatcccagcactttgaaataccaagacgggagaatcaatcatttgagcctaagagtttgagacagcctgggcaacatagtgggaccccatctctataaaactaaaaaattaggccaggcatagtggctcacgcctgtaagcccagcactttgggaggccgaagtgggcagatcacaaggtcaggagttcaagtccagcctggccaatatggtgaaaccccgtctctattaaaaatacaaaaattagccaggcgtggtgctgggcgcctgtaatcccagctactcgggaggctgaggcagaagaatcgcttgaacccaggaggcagaggttgcagtgagctgagattacaccactgcattctcaatcctgggcgacagagcaagactccgtctcaaaaaataataataataattagccgggcgtggtggtatgcacgtatagttccagctactcaggaggctgaggtgggaggatcacttgagcccaggaggtcgaggctgcagtaagctgtgattgtgccactgcactcagcctgggtgacagagtgagaccctgtctcaaaaaaaaaaaaggcttgaaatccttctcattgtgcttctgtggaacagagaccagttgaaattggtggaggcgaactcccctacccctgggaaaagttccagctctctctgttccccaggccagcacctcaaagcctacagccctcagggcagtttcccaggccttaggaaggcctggtcaggtgtgaaggaggaaaagtcagggatttctggctccacgccttctatgctccagcggacgccactcaccgttctcattaggaggggtatcttgagcatagtgaagatgaatggtgcaagttattcttgagccttcctgctgtggagcacttctccatttggggttgggcaaaggcccctgcctactgcactcagggttcctgaatcaaactagaatggaacacatagcaagtaggaaaaatttcccttgcaaatcccactggtcattctgagtaaaaggcaaaagtaagtcctgacaatggtctacaaggcccaatatgatctgagttccctttcccctcctgatttatggttcagctcccatcactccttcccccctctcaccttcttccctcggccacacttgcctccttgccgttcctcgactgccaggcatgttcccctgtcaggacccttgctcttgctgttccctctgcctggaaccctctcccctaagatgtatacccatggctcactgctttacctcccttcagatctttgttgaaaactatcacctgctcattgaggcttttcttggccacttcatctaaaatcacaaccctctccacttctctgattcatttttcccttcgcacttctttctgcctactagagtctatttacttgtcctactgcctgtcttccacccccagaccatatggtccatgagggcagatttctcttgactgctctcttcccagcccctagcaatgtcaggtacacagatgctcaataactctatgttgaatacatgagcagatttattattgcattaccgtatttcttcacagatgaagagccaggtcaaaggatttgtcttacctatttcgtagggctgttgtgaggacagagacaattaaaaagtaaatgactgaaaagctaaacatgttatattaactcatgatgtaaaatcgccctgttcccagccccactaatgcagcatgcctggcatttctttttttttttttttttttttttttttgagacggagtctcactctgtcgcccaggctggagtgcagtggcgtgatcttggctcactgcaccctccgcctcctaggttcaagtgattctcctatctcagcctcccgagtagctgggactacaggcgtgtgccaccgtgctggctaatattttgtatttttagtagagacagggtt[141 bp omitted]tcacccaggctggagtgcaatggtgcgatctcggcctactacaacctccacctcctgggttcaagtgattctcttgcctcagcctcccgagtagctggaattataggcacctgccaccatgccaggccaatttattttttatttttaatttttagtagagatggggtttcaccattttggccaggctggtctcgaactcctgacctcaggtgatccacccacattggactcccaaagtgttgggattacaggtgtgagccactgcacccggccaaagtgtgaggcatttctgatggagagctttttcaagcttattgccagtttcccagggtccactacacatcaggggatggtaaattaggagttgccatttactgagtactgctatgtgttaagcactgcagtgcacatcatcatgcattatctcgtttaatcctcacaacaaaactgtgtgtgggtatatcagtgtacccatttaaaagatgagaactttgcacaaattgcccaacctctctctgattgagcagcaaaacaaagttatgatcatatgtctgtctgattttttttttttttttgtgggacagggcattgctctgtcacccagggctgcagtgcagtggcaccatcttggctcactgcaacctctgcctcctgggttcaagggattctcctgcctcaggctcccgagtagatgggactacaggtgcatgctaccatgcctggctaatttttgcatttttagtagagatggggtttcaccatgttggccagtctggtctcaaactcctgacctcaagtgatctgcccacctcagcctcccaaagtgctgggattacaagcgtgagccactgtgcctggcctgatacattctttttaaaaaatatttatttatttatttatttattgagacagagtcttgctctgtcgcccaagctggagtgcagtggcgcaatctcggctcactgcagcctcaaactcctgggctcaagtgatcctcctgcctcagcctcctgagtagctaggactatgggtacacagcaccatggccgagtaaattttttatttttttgtagagatgaggtctcactttgttgctcaggctggtcttgaactcctggcctcaagtggtcctcctgcctcggcctcctaaagtgctgggattactgccagccactggcagtggccactgcacccggtgtgagccactgcacccagtcagttctatctgatatattctttccaccacagtaggaaaagtatttttttttcttatttgttttttctcatcagcttctactgacccaggaaaagtacttttggatgacaaaaataatgcagacttttattatcatttaaaaatacaaattcaaatgattttaaggtactacaat[138 bp omitted]acatggtgaaaccctgtctctacaaaaatacaaaaaaattaactgggtgtggtagtgtgtgcctgtaatcccagctgcttgggaggctgaggcaggagaatcacttgaacctgggaggcggaggttgcagtgagctgagatcgcaccactgcactccagcctgggcaacagagtgagactctgtcaaaaaaaaaaaaaaaaaagaaggatggtataggatggtatagttgtggggagggaacacttacacattgccaatggcaaagttggttcattctcttcaggaacacagtctggcaacaggaatatacaaatgggttccttataaaagaaaaatcagagaatgcccatcacctcagacagttaaaattacttttataataaaaaaaagacatcactataaaaaatgcccagtgagcaaaaagatacaaattagaaaatgaaattacccaaaatacccgtttctattaccccaaaggtcacttaaccatggataacagttttgtgcatatactttttcattgttttttgccttgtgcatatacttctatgtgtctgttgattgtgagtgtccagtagtatgtagttggctaagccatccatgatcaagtagtacagtgagatactgtttcctggaagtgagtatatgaagcagtatcatgtaaaaatcacaaaacacactcactgctgatacataaaagtctgctgcctgcacacggataaaaatgggaggagattcgcctgatgaaaatagttaaatttaatgtcatgtgtaaggctgccttcattcacaaaagggaggaaaaatccactaagagccaagctgagaagaagaaactcttagaactgaggcttctagtggggtggagaaagcactgagcgggctgctcaggagtcctgggtaccagtcccagtttattgtgttagactgtccctacctacttctaggccctggtatcctcatctgcaaagtgaagggctgcattagattatctctagtgacctattcaatgttataaagtctgtgattgtgtgacagattaaacattagggctagaaaagtatattgagtaatatagaacagttgaaaaaaaaggcatgctctggctgggtgcggtggctcatgcctgtaatcccaacactttggaaggccgaggcaggtggatcacctgtggccaggagtttgagaccagcctggccaacatggtgaaactccgtctctactatatgtgctgccgaagcgagcacagaaactccatctctactaaaaatacaaaaattagccaaatgtggtggtgcacacctgtaatgccagctactcgggaggctgaggcagaagaatcacttgaactcgggaggcggaggttgcagtgagccgagaaaacgccactgtactcaagcctgggtgacggagcaagacttcatctcaaaaacataaaaaaaaaaaaaaagaggcatgctccaatgagccataaggggttgactgttgggccccttcattaaaaggagtaatgattttggggccaggcgtggtggctcgtgcctataatcccagcactttgggaggccgaggcatgtggattacctgaggtcaggagttcaagaccagcctggatctctactaaaaatacaaaaattagctgggcgtggtggtgagcacctgtaatcccagctactcaggaggctgaggaaggagaatcgcttgaacccaggaggcggaggttgcagtgtgccgagatcacgtcactgcactccagcctggaagacagagagggactccgtctcaaaaaaaaaaaaaggaaggaataatgactttgggaggccgaggccagtggatcacttgagcctaggagtttgagaccagcctgggcaatatagggagactgtcatctctacaaaaaatataaaaattagccaggtgtggtggtgcatgcctgtatgtagtctcagctacttgggaggctgaggcgggagggtcacttaagcccgggaaggttgaggctacaatgagccatgatcgtgccactgcactccagcctaggtgacagagtaagaccctgtctcagaaaaaaggaataatgatacatgaaagaatacacagctcctgatctcaaggaatctcgagtccagtgctcttctctggactgaaacagccaattgggtacaagtttgaaataagctgaggcaaaaggccagcctacattttttttaaaggagggcctgaaatctttttgatgtctcctgtactccctctccacattactgggacttgttagactctcccaattccttccttctgtgaaccttcatcttaattcaggctcttctttgattcagaagcttctggtgccctgagagccagcccaaggaagttcagttgaattgaatttgttgaatacctgtgaaatctaaggccctgtgccaggaatcagggatgcattttgacttctgtgggccctaggcactcttccctttgtatccccctttctccttcaaaagatgaaaaaattcaagacagcactggtataaagatgaatataatcatgaccctaaaattcatatattcttcttcttttttttgaggcagagttttgcttttgttgcccaggctggtgtgcaatggcgcaatctcgtctcaccacaatctccgcctcccgggttcaaacgattctcctgcctcagcctcccaagtagctgggattacaggcatgcaccaccacgctgggctaattttgtatttttagtagagactggattact[141 bp omitted]tgtgggccctaggtattgagcttactatgccttacagataagtcagccctgttagaaatgttttaatattggccgggcatggtggctcacgcctgtaatcccaacagtttgggaggccaaggtgggcagatcacgtgaggtcaggagttcaagatcagcctgaccaacatggtgaaaccctgtctctactaaaaatacaaaaattagctgggtgtggtggtgggcgcctgtaatcccagctactcagggaagctgaggcgggagaattgtttgaacttggaaggcgaaggttgcagcgagccgagatggtgccattgcagtccagcctgggtgacagagcgagactctgtttcaaaaaaaaaaaaaagaaaagaaattttttaatatggagactacaacgcagacagttccttatggctgtactatgcggggatgtctcaagtgccataagacaggcagaaaacaagttccaccagtgttcaaagggaaagggtgtgaagtcacatctggttggaagagggatcagaaagacttcttggaggtggtagttttaaggaaaacagaatttatcaagtaggtgatagagagaagcttctcaagaaatgacaacagctggatcaaaagcatggtgtaaacatggggaatagtgctagctatagcttgatgggaatatgagcattttgttgagaaaagtgtgacatgaaacttgtttttttttttttctgagacaaggagttgcccagcctggagtgcagtggcacgatcatagctcactgcagtcttaaattcctgtgctcaaacgatcctcctgcctcagcctcccaaagtgctgggattacaccacgcctggccattgtgggaagtcttaaatgacacagtgaaacattttcattttgtttggcaggcaatgggggagctgctggaggttgctttttttttttttttctgagatggagtttcgctcttgtcgcccaggctgaagtgcaatggcgcgatctcagctcactgcaacctccgcctcctgggttcgaaggattctcatgcctcagcctctcaagtagctgggattacaggcgcccaccaccacgcccggctcatttttgcatttttagtagagacggggtttcaccatg[136 bp omitted]gaagctgtgcttaaggaaaataactctggcttcattgtgggtgggggattggagaagtgaggttgaggacaatggagtctagatgggttattgcctaagtccaggtgagaaacactaagagctgaagtagagcagtggcagtgggactggagaagaatggatagatttgagacacatttcaggtagaatagatatgatcgaaggttaataaaaaatggattaaggaaggaaggaaagaaggaaagaagaactgaatgaatgctacttttttttttttttgagatggaatttcactcttgtagcccaggctggagtgcaatggcatgatcttggctcactgcaacctcctgacttcaagtgatccgctcacctcggcctcccaaagtgctggcattacaggcgtgagccactgtgcccagcctaaatgctactttcaataatgtagttaaccttagttgtgtacagttggctctccatatctgcaggggaatacgttttcagaccctccatgcatatcaaaatccacgtgcgctcaagtcccttagtcgtccccccatccatggatgtaaccaactgtggattgaaaaggttggccctatgtattagaatccgcagtggtgggactgtattcccatctcaactccaagaataggcccagacaaaggagacattccaaggaagattttgtttctcaactctcatcactacgaagatttgtgccttgaaaggggaaagcgcctgggagtggtggctcatgcctgtaatcccagcactttggtaggctgaggcaggcggattgctcgagcccaggagttcaaggccagcctggacaacatagcaagacctggtctctaaaataaataaataaataaataaataaataaaataaaataaaataaaataaaattttaaaaagaaagggggaagcttctccaagggtgcaaacaaggaatccctcctttctgtaggatgtggattattctattgcctccctgaacttattttatataccacctatggctacaattaagtgagttggattttcacaaatggctaaagccagcctcattactttccagtcacacatttaggtctcctgggatgagcagaacaagtgttctaatcactttctaattattttccaattaattgaacctgcctcctgtgagggggtctgaagcaacatctgtgtgtatgtacatgtagacattgaagggtgtgccttgctgggcatggtggctcacacctataatcccagcactttgggaggccaaggcaggtggaacacttgagctcaggagtttgagatcagcctgggcaacatggtgaaaccccatctctaccaaaaatacaaaaattagctgggcgtggtggcgcatgcctgtaatcccagctactcgggaggctgaggcaggagaatcgcttgaacccaggaggcagaggttgcaatgagccaagatcacgccactgcactccagcctgggtgaagaagtgaggctctgtctcaatcaatcaatcaatcaatcaatcaatcaatgtgtgtccctacagtccaaggctcaatctcaactgatgtttgcattcttcacttgtttcatttcagcttaaccttttctctcctccacccatggtgataattgggagctgaccctagtttgaccccaataaaaaaatattaggagtggccaggtgcggtggctcacacctgtattcccagcactttgggaggccaaggtgggtaaatcgcttgaggtcaggaatttgaaaccagcctgaccaacatggtgaaacgccgtctctactaaaaatacaaaaagaattagccgggcttggtggcatacgcctgtaatcccagctacttgggaggctgaggcaggagaatcgcttgaatctgggaggcacaggttgcaatgagccgagatcatgccactgcactccagcctgggcaacagagagagactccatctcaaaaaaaaaaaaaaaaattaggagcggactccagaacagagctctaaccctgactgttacatgccacacttatcctttatttttatttattcgtttttttagggatagggtcttgctctgtcacccaggctggagtgtagtggtgcgatcacagctcactgcagcctcaaactcctggactcgggcaatcctattgcctcagcctccccagtagctgggattacaggtgcgtgccaccatgcctggctaatttttaaatttgttttgtagagatagggtctt[133 bp omitted]aaggcttttctttttctgtgtgctttttcttttttctatgaaacagaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggtaagttcttctttttctcccttcagtgaggcttcagtgagaatggagacttctcttgtcaaggtcatcaataaccccatttttacaaaatttaatagtcatacttctgtcctcatcttactggcctatgcacggcacttgccaaaactgatcactccccgctccatgaaactttccatttggcttctagaacaacatactttcctgattttcctcctgcctcactgaccattccttcacagtccgtctctactggtagtttccctgcctcataccaacctcttcatgttggaatgtcctgaaactcaggccttggacctcttctctaatactcagttctgtggttatctcttccagtctcatagctttaaatgccacctagagcttatgttccccaaatttgtatctctagcacagacccgtcccacgtggatgtttaataaacatctaatttattgtatgtaaaactgaacttctgattttcccttccaagcctatctacttgcagtcttcatcttagttaatagccaaaatccttggtgtcatccttgactcttctctcatatccctcatctaatccattaggaaatcctattggctctactttcaaaaatatatccagaatccaacaaatttttttttttgagacagagtttcactcttattgcccaggctggagtgcagtggcacgatcttggctcactgcaacctccacctcctgggtttaagtgattctcctgtctcaacctcccaagtagctgggattacagtcgtgcgccaccatgcctggctggtttttgtatttttagtagagatggggtttcaccatgttggccaggctgctctcgaactcctgatctcaagtgatccacccaccttggcctcccaaagtgctgggattacaggcttgagccaccgtgcccggcccccccaaacaatttcttactactccacttctatcatcctggtccaagacaccatcttctctcaccaagattatgtcagtagcctcctaatcagtctctctgcttccacccttgccctcatcatgtctgttttcaatgttgcaggcagcctgaatgagtcttgtaaaacaaatttttctttttctttttttttttaagagatggtgtcttgctttgttacccaggctggtcttgaactcctggcctcaggctatcctcctgcctcagcctctcaaagtgctggacttacaggtgtgaaccaccacgcccagctgtaaaacaaatttgtcacttttgtgtttaaaattttccaaaagtgcttctcaaacttctctctcttttttttttaagacagagtcgctctgtcatccaggttggggcagagtggtacaatcagagctcactgaggccttgacatcccaggctcaagtgatcctcccacatcagccttccttgtagctgggactacaggtgcacaccaccatgcccagcaaactttgtgctgggattacaggcgtgagccaccacacccagctgtaaaacaaatttccgtcactcctctgttttatctatatctgtctgcctatctaatctatctatctatctatctatctatctatctatctatctatctatctatcatctatctatatctatctacttattgagacagggtctcactttgtcaccctggctggcgggcagtggcatgatcagggctcactgcagcctctacttcttgggctcaagccatcctcctgcctcagccccccaagtatgggactacaggcatgcaccaccacgcctggcttttttttttttttttttttgagttttcgtagagacaaggtcttgctatgttgcacaggctggtcttgaactcctgagctcaagtgatccacccggcttagcctcccaaagtgctgggattacaagcgtgagccaccgcgcctggcccattcttctgtttaaaactttccaagggcaggcgcggtggctcatgcttgtaatcccagcactttgggaggcttacgcgggcagatcatgaggtcaggagttcgagaccagcccgaccaacatggtgaaaccccatctctactaaaaatacaaaaattagctgggcatggtggcgcatgcctgtaatcccagctactcaggaggctgaggcagcagaattgcttgaacccaaaaggcggaggtcacagtgagccgagattgcgccactgcactctagcctgggtgacagagcgagactccgtctccaaaaaaaaaaaattaaaaaaataataaaaataaaaattaaaaaaaaatagataaacttt[132 bp omitted]tgaaaccccgtttctactaaaaatacaaaaattaggccgggcacggtggctcatgcctgtaatcccagcactttgggaggccaaggcaggcggatcacctgaggttgggagttccagaccagcctgaccaacaccctgtcactactaaaagtacaaaattagccaggcgtggtggctcatgcctataatcccagtaactcgggaggctgaggcaggagaattgcttgaacccaggaggtggaggttgcggtgagctgagatcatgccattgcactccagcctgggtaccaagagcgaaacaccatttcaaaaaaaaaagaaaaacacaaaaatatagccgggtctggtggctcatgcctgtagtcccagctacttgggaggttgaggcaggagaatggcttgaacccaggaggtggaggttgcagtgaccaagatgatgccattgtactccagcctgggtgacagagtgagattccatctcaaaaaagaaagaaagaaagaaagaaatttaaagtttgtacaaattacttagggatcttgttaaaatgaagaatctgattcagcaggtgtggggtagggattcagattctgcaagactaacaagctcgcagaccatgctgaggctgcaggcctagagaccagctttcagtagtaagggcctacaaggccctgtgtgatctggtcccttgttacttgtgctttcccactactccttccctctcactgtgctctggccattctgatcttgcttctcctcaaataagtcaggtatagtcctgcctcagggcctttgcacttgctttttcttttgactagaacactctcccctaggcatgtgaattgcctgctccctcacctcctctttcactcactttcctatgctttttctccatagcactcaccaccttttcatattctatataattgtttttgttttgttttgttttttttttagatggagtctcgttctgtcttctaggctggagtacagtggcccaatctcggctcactgcaacctctgcttcctgggtttgagtgattctcctgcctcagcctcctgggtagctgggattacaggcacatgccaccacacccagctaatttgtgtatttttagtagagatgggttatc[133 bp omitted]ccatcagaatgtaagctccataaaggctgggatttttgtcttcctgtaaaacaaggcctggcaaatagtaggcactcaataaatacttgaaagaatgattgctggtatccacgaggtagaccatgaataagaaatatgttaacttgatagctggtgtgaaaagagccaaaataacatccatgaatctaggggaagggtcgtcagaggagcagggctggtaccaagcatagtgcctgaaacataacagacataaacattttatttcctctttgccttcccatcctttcccaaaagttatttgcaccttggcctgatgttaagattttgtatatgaccacacagtcagtgagccatctatgtcctatattcatcctatcctagtacaaatgtgcctattcagagcgtttggaacctgcagtaatctaaagaggtgcaatatgcggagatcttacttctggtcatatatccctctaccagctgtcttgctaattggccaggtcagaggtcaggaaatgagactggtggaggggaacaagactacaccagagaccacacagagagaggtcttgggagaatggctcttgctcaaaattccaagtataattttggaggcgaggatgggagggactactgagacaatattacaacctacatgtttatgctgctttaaaaatgtttctcaccttttcatctatattaattcattttcatgccattcctatgaggtagagattgtcagttgagtaaagtggagcatgtaaagaaggttaatgacttacactcctattaatgaggagcacaagcctgtcccaagttatttccaatattgtaaagattcttaaggtatttgttgtcaaaaagatattttggggaacggaggtttaaagtgacaaaaaactatcacctatagattcccaattcataagcaagatgaattctagaaattcaaaagtatgcatatg[142 bp omitted]taaaactccgtctctactaaaaataaaaaaaatagctgggtgtggtggcgggcatctatgatcccagctactcaggaggctgaggcaggagaatcacttgaacccagggggtggaggttgcagtgagctgagattgcaccactgcacttacacctgggagacagagcaagaagactccatcttgaaaaaaacaaaaagagttggtatgactggtctgggctaacagttgtccttctcttttttaggatgcacccattgttgtttcttatgtaggtgaccaccaagcattagttcacaggtaatgaacatttggaggtttgttttaaaagggtgggagaaaggtcatcacactccaggaatccagcagttgcgcaacaacagatagttcatgtaatggtcacttttcttctttggaccaccaagcccattagaatgggctgaaactgttctagaaaattatttttcttagtgtctggtttttcattcattataagcttgaggattagttgctggagtggggtggaggcaaagtgggtcatgtctatcgtttctaaggaaaacttcaatatcacataaaattaactcatgtataataatcccttttatagcagctctcttaaagtatctttacatataagctcataaatcctttcattgactgggcttaagaaacagtaaaggatagacatagagaaccttagctacctcccctcccccgccaataaaagaggcttcttgcttactaggaatataaaagagtaaatagggaatcccctttgtttgattttaaaagcttttgatttaaaaatactttaaaagtgtttgtttttcttcctttgtagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccacatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcattctgtctcccaggccggagtgcagtggcttgatctcggctcactgcaacctccacctcccaggttcaagcaattctcctgcctcagcctcccgagtagctgggactacaggcacgtgccaccatgcccggctacattttttgtatttttagtagagatggggtttcaccatgttagccaggatggtcttgatctcctgacctcatggtccgcccacctcggcctcccaaagtgctgggattataggtgtgagccaccacgcccagctgagaataaaatttttaagtgggtattacaaaattcaggttttattattcagggaagtagatggattgagactcaaaactttgggaactagtttcttttaacttttgaaaactacagatttattaggctaggcagcaactacaattaggtataaataaacagaaatcatttcaaattcaggggtcattaatgctgctacatgctgactcttattttcagtagttgcgggttaaaagtagacatttcctggaacatatatttaatagtatttaagactgttaatactgtttaattataaaactttgggccgggtgtggtggctcacgcctataatcctagcactttgggaggccgaggcgggcggattgtttgaggtctggagtttgagaccagcctgggcaataaggtgaaaccttgtctctactaactatacaaaaattagctgggcatggtggtgcacactggtagtcccagctgctcgggaggctgaggtggaggattgcttgagcccaggaggtggaggttgcagtgagccgagattgcaccactgaactctagcctgggtgacagagggagaccctgtctcaaaaataataataaaaaaacttttgctctatactttgaaatatgactgccttatttaaacacttttgaaaaacaaccacttaaaaatataaggcaagcgggcattttacaatagtataatcagaatgtccttatcactcaggtaatttaaatttatcataggcatgtaataataatgcagatcaaataaccttaacaaaaacggccaggcacggttgctcacacctgtaatcccagcatttcaggaggctgaggcgggcagatcacttgaggtcaggagttcgagaccagcctggccaagatggcgaaaccccatctctattgaaaatacaaaaattagccagttgtggtggtgagtgcctgtaatcccagctacttgggaggctgaggtgggaggatcacttgaacccaggaggcagaggttacagtgagccgagatcacaccactgggctccagcctgagtgacagagtgagactctatctcaaaaaacaaaaaacagaaaaccaaccttaatgaaaacagccaaaacttcctgggttccctcccccattcactcttctgacctaattaaaattgaacgaaataaacaaaggaacaagaccacgatatcatagtcccacaattttccatttctccccaacttaaaaacaaacagaaaggtttaagtgtttaaaatgaaatctacttagtatatgaaagacagttaaaaatatttaatatcattttagtttctcttatgaaacaattaagctaaaatactgactcattatatttttccttatcaaaactcttgaccatagttgactcctattcttttggatgttatcctatcctcaagctcatatcagctcagattgaaataaagtatttacatggggataagagtagacttcttaagactttatatttcaaataactatttttaagtaacttattaagaatttaggctggacgcagtggctcatgcctgtaatcccagcactttgggaggccaaggcgggcggatcacctggggttgggagttcgagaccagcctgaccaacatggagaaaccccatctctactaaaaatacaaaattagccaggcatggtggcacatgcctgtaatcccagctactcaggaggctgaggcaggagaactgcttgaacttaggaggtggaggttgtggtgagccgagatcaccccattgtactccagcctgggcaacaagagcgagattccatctcaaaaaaaacaatttaaaatatctaatgttcacattttcaattcaacaaatctgtgggttagtttgctttttggtttgtttgttggttttagagtggaggtagggacttaaatcaaaacccattatttccagggtagatcatatattatagtacacaagtcagttttcaaattccagatttgcttttcgcagcaatgccttcattttgttaacaaaagtggcctcctatatgttcctatcaagtccatttataacacattcaacacagaggagtgataatttcccaaaagttcagctggggtagaggtcggggtggggcaggcatcacatagagctaatagtagcactgtctcatggtgtgagattgaagtttctcatctcactaacactttttgttcaagccacctcctccaatacagtagcattttattcataatttggattttttttttttgagacagagtttcactcttcttgcccaggctggagtgcaatgtcacaatctcggctcactgcaacctccgcctcctggattcaagcaattctcctgcctcagcctcccgagtagttgggattacaggcgcccaccaccacgcccggctaatttttgtattttttggtagagacagggtttcacca[139 bp omitted]gctggagtgcagtggcacaatctcggctcactgcaacctccacctcctaggttcaagcaattctcctgcctcttcctctcgagtagctgggactacaggtgtgcgccaccactcctggctgattttgtattttcagtagggacagggtttcaccatg[133 bp omitted]tcaatccaaaataacccaaagaacttgctaaagttatatcaataagcagctttttattgaaggactgaaagaattaaatagaaggcacagtagcactgtaaagctttctcagaacataataatctttttctatgtatgtgtggaacccagactttcttttttgttgttaaaaatgtcttctggacaatcagaaaatctttatttgtcatccttccctttggtctttctgtaaaccatttctcgaaaactggccagaatcttgttctctctctttcgtctctcttcttggttaaaggatgcaagggctctcttctcatcagcactgtagatctggttctcttttcgcagtcgcacagcctccattcggcgatgcctggagagaattttatttttggcttaatttctcagtaattattttcatagtacatcatcattaatcctttcttacccagagtggtctatttaacagctgacaaaaattgaaatgggttaaatttccaaaagatcatttattaatattttagctgcctgacacgtcctttttttttgttttgttttgagatggagtcttgctctgttgcctaggttggaatgcagtggcacgatctcggctcactgcaacttccacctccctggctcaagcaattcccccatctcagcctcctgagtagctgagataacaggtctggctaatttttgcatttttagtagagatggggtttcaccatgttggctaggctgatctcgaactcctgacctcaagtaatccgcctgtctcagcctcccaaagtgctgagattacaggcgtgagccaccgtgcccggccctgatatgtctttgattcatttccactattcaaataatgatctctgatttcctgtcaacatagtaaatgttatccttttttcttttttttttttttttaattttttttttttttttttttgagacggagtctcgctctgtcgcccaggccggactgcggactgcagtggcgcaatctcggctcactgcaagctccgcttcccgggttcacgccattctcctgcctc[224 bp omitted]gctctgtcaccaaggctggagtgcagtggcacaatcttggctcactgcgacctctgcctcctgggctcaagtgattcccctgcctcagcctcccgagtagccgggagtacaggtgtgtgccaccacgcccgactaatttttgtatttttagtagagatggggtttcgccatgttggccatgctggtttcgaactcctgacctcaggtgatccacctgccttggcctcccaaagtgctgggattacaggtgtgagccaccatgcctggccgctatcattaatttcaaatactaagggtatacgtctaatttgtttccagtaaaacaatcagaaatgggcaaattattaaacttcctaggtgacatatccatttgcctttgtggaattggaagtaggatagataaaacatttaactagtcattaatcagatggaacttccttcaaggttctactttaccataaaaccaaaagaaccaagtctaggctgggcatggtggctcacgcctgtaatctcagcacttttggaggctgaggcaggcaggtcacctgaggtcaggagtttaagaccagcctggccaacgtggtgaaacctcgtctctgctaaaaatacaaaaattagctgggtgtggtggtgggcacccgtaatcccagctacttgggaggctgaggcaggagaatcatttgaacccaggaggtggaggttgcagtgagctgagattgcgccactgtactccagcctgggagacaagagtgaaactaggtctcaaaaaaaaaaaaaaaaaaaaaagaaccaagtctaaatctgtaattgaacagcagtttttatcagtggatttaacttccaagtctccctctgtcacccaggctggagtgcagtggcataatctcggcttattgcaacctccgcctcccaggttcaaccgattctcctgcctcagcctcctatttcatgtactgaatagttctttctttccccattgatctgacatgctatctctttcatacactgaagttccatacgtgtatggttatctttgggctctgaattttattttatttttttttgagatagtgttttgctcttgttgcccagactagagtacaatggcgaggtctcagctcactacaacctccacctcatgggttcaagcgattctcctgcctcagcctcccaagtagctgggactacaggcactagccaccacgcccagctaatttttgtatttttggtagagatggggtttcaccatgttggccaggctggtcttgaactcctgacctcaggtgatccacccgcctcagcctcccaaagtgctgggattacaggcatgagccaccacgcccggcctgaattttattccactgaacaattcagttgttctcctatgctttctaaagtgctgtaagcttcataataagtcctcctatttgtaggggaaatcttaccttcctgctcttctttttcaggagtgacttggctattcttgtccttttagtctagtatataaattttagaactggcttattaagtttcatgaaaaactgtgttctgattttgattgggactgtattgaatataaagatcaatttgggaagaaatgacaactttacaatattgccttcctatccgtgaacctggtatctctccagctatttaagttttctttaatcttaccttcttgctcttcttcttcagaagtgacctggctattcttgtccttttagtgtaatatataaattttagaaccagcttaataagtctcataaacaactgtgttgtgattttgattggaactatattgaagatatggactcttaatgtcttacatttttccccatagaaccttgggcatcttttgttaagatttattcttaagtctctcatattctgacactgttataaacgttcaaggttctaggtttctgttgttagtaaatagaaatgcagttcatttttattggaactgtattgaatacacaatctcttaataatgttttatagttttcctcacagagccctgggcatcttttgttaagatttattctgaagtccttcatattctctgatactattacaaatgttttcttcttatttagttacattttctagttgtctgttgctggtaaatagaaatgcaatggatttttgtgtactaaccttatatccaaccagttgttaaaccctcctctcatttataatttatctggagattctttgggattttctatgtaaacaatcaaatcattcaccatgtcattcacaaaaaaatgacattttttttttaagacggagtttcactcttgtcacccaggctggagtgcaatggcacgatcttggctcactgtaacctcctcctggattcaggtgattctcctgcctcagcctcctgaggagctgggactacaggtgtccgccaccatgcccagctaatttttgtatttttggtaaagacagggtttcaccatg[137 bp omitted]attattattactgttttttcaggctgagttttgctctccaggctggcatgcagtggtgtgatcttggctcattgcaacctccgcctcctgggttcatgcgattctcctgcttcagcctcctgagtagctgggattacaggtgtgtaccaccacgtctggctaatttttgtgtttttagtagagaagggtttcgccatgttgcccaggctagtcttgaactcctggactcaagtgatctgcctgccttggcctcccaaagtgctgggattacaggcatgagccaccgtgcccagccttcctttccaatccttgtgtctctaatttctttttcttgccttactgtgtgggtcctccaatgcaatgcttcaaatattggtcctcagtattacaagattctggaggtgcttcagggtttctgcaaatatttgccttcagtgtcatttaaaaatagttatctacttaaaaaaaaagtttatcaagttttaaagaatccaaaattcaatttgatctaagtactgctgccctatttgctcattctcctggttcttcctggaacttttctctttcctaattttatattcatttcccatgctgaatccagtgtctttttaaaatttatttatttattcatttatttattagccaggatatattctcagctgaccaatgtcttttatcatctttttctgttattcagtctcagaaatctgggtccataaaaaactgaagacaaacttgtaaccaggaaacactgtcttgtgaaaatattttcctaactgccacattcctcatggggcagtgataaatagctgaatttaactatatcctccagtggataaaatatctgtaagcaaataccaactaggaaaggacattaggaagattgattctttgaagtcagagatatagctgagtttgaggctgagttgcatatatacttggaattgcagaaaaccatgttatactaacaacactaatatcaaaccaatatttatactctacttttcataagaaacagtcacttaatgaaaatcaattaccaaaatataattctggtagtaaaaaagaagaaaaagatctaatcatggaaactgagcttaatgccaacaacatacctgctaccactcattacataacctgagcattcaaatgatgcaatttcttcacttgtcaagccaatttcacctcttcgtgggatacgttttccagcttttacatattcagccatagctgcaccttcaccaggtaacagagcatggccatagctacaaagtaattcagaattcagaaaaggtccattaaatcatcttaatattaaaagcttataatctaaagagagcaccaaaaatccccacattttctctcaaacaagagtaggaataacagtgctcagcagtagtgtgctaggaagctcaatgtgaattgctttatcctaattagtgtattaaacattgcattgcactatgacctatacaactaacccagaaatgcagaaatattttgaaagaaaagaactgctgtgagtatagattcacagtttacaattatggattaatttatccctacaggtattgtcattactggttctggctccagctgattccctttccctttttcccttaaaaaatccaaagtatgccaggcacagtggctcacgcctacaatctgaacactttgggaggctgaggcgggaggatcacctgagatcaggagcttgagagcagcctggccaacatagcgaaaccccgtctctactaaaaatacaaaattagccgggcatggtggtgcatgcttgtagtcccagctactcaggaggctgaggcaggagaatcacttgaacctgggaggcagaggttgcagtgagccgagatcgtgtcactgcactccagcctgggcgacagagtaaggctttgtctcaaaaaacaaaacaaaacaaaacaaaaaaaaaaaacaaagtaggctgggtgcagtggctgacgcctgtaatctcagcatttttggaggttgaggcgggcagatcacttgagatcaggagttcgagaccatactggccaacatggcgaaaccccagctctactaaaaatacaaaaattagtccgggcgtggcggcaggcgcctgtaatcctggctacttgggaggctgaggcaggagaatcacttgaatctgggaggtggaggttgcagtgagccaagatcatgccactgcactccagcctgggcaacagagtgaaactcaatcacaccactgtgcttcagcctgggagacagagtga[145 bp omitted]tggtaaaaccgtatctctactgaaaatacaaaaaaaaattagctgagtgtggtggcgcgtgcctgtaatcccagttactcaggaggctgaggcaggagaatcgcttgaacctgggaggcagaggttgcagtgagccaagatcacgccactaaactccagcctgggcaacagagcgagactccgtctcacaaaaagaaaaaaaaattctgctggtaaaaaaagaaaaaagagaaaaaaaggaataaaaaattctgtgaggatcaaagagaaacagaaatcacacctacttgtggaggggaagtattgggaatcagcatatgcatctccttttgaaaagggcttcgaaggatagtaaggattttaacaggaagaaactggcgatagggaagaaaacagagggcagggaaaagaagggaaggcatactggatgaagaaataagctgaacatggcataaaagttgcaaagtgcacattaagcccagggaatatttagtagtccagctcagctggaacctggagtagaaataagggaatagagtcagataagcttggcaaggtaagttagaaccagactttttggtaggtactttagatattataaacacactgctgcttacttcaaaggtttatcatcttgagaggtaagtgtttttggagcctctgggccaattaaatctgatggttcttcagcctctgcatgaaagatattaagaaacacattcacattctgactaattggttactttaatgtttcatctgttctgagttagtctatcagaagaacctacttgttcgatccttccagggattttccagaaactcttcttgggattctttagagcttgaatcactggactcttttctgctcttcttagacctctttttcttatatttcttcctatagggattttaatttgatacaaattcacttaatcttcctatgttagagggcatcttaatttttcttttctttttaaattttgaactggtgactatacatcttaatttttcaaggcaaagaaaggtgacaataaaatgatctgaattcccagcttattcaaacttacaagataattttacttaaaaaaatctgcttctaactgaacctgggaaacagagcaagaccccgtctctattaaaaaaaaaaaaaagtagctgggtgtgatggcacacatctgtagtctaagctattcaggaggctgaggcgggaggatcacttgagcccaggagttcgaggctgcaatgagctatgattagcccactgcactccagtctgggcaacagagcgagacactgcctcttaagaatttttttaaaaagtattctaacttatttaaccaaatcatcttttgctataaaaattatcactaaaggaggctgggtgtagtgtttcacccctgtaatcccagcacattggaagactgaggcgggtgggtcacttgagcccaggggttagaaactagccctgggcaacatgacgaaaccgtgtctctacaaaaaatacaaaaattagccaggtgtggtggcacacgcctgtagtcccaggtatggggaaagtgggggcagaggtgggaggatggcttgatcctggaaggttgaggttgtagtgagctgtgatcgtgccactgcattccagcctgggtgacagggtgagacacggtctcaaaaaaaaaaaaattcactaaagggaacaatgaaatacagttctgatgttgtagaaagacaacagaaataaaacagcctaaaaagtcccaacaatttgaacattatgaataattttatgtgtaatggattaaaatatgtcaaatatgtttaaatccttgggttaataatactttttaaaaatccaattcattatttgaaaagtcattaaaacaaaaaaaatcaagcaattatcctgctcttacaatataaactatatttcagggtatctaaatagttgatgagggtaagtttctcttatagaatcattctgcctaataaatgaaggataaagccaggattagactatcaccattttacaacccctaatgaaataatggatcgagataatgaccatcaatggctgttaatatgacaaaaagtgacaaccagacattatttgcctcctgacagtaaacagcaccacttatgaagtattcttgccccaactcaaatctgagccttctcaggcctctagacctattaatctattggaaatacagaggacagaacatgccaaagaataccataagaatacggtcactgcaatttagggacattatttggatcctgattggaataaactacagaaaaaactgctgagaatagaggaattattattaaatgttttaggcacaataatagcattctggttatgggtttttgttttttttttaaatatagagacaggatctcgctatgttgcccaggctggtattgaactcctgggctcaagcgatcctcctgcctggcctcccaaagtgctgagattacagatatgtgccactgtgcctggccagttttttgttttgttttgtttt[143 bp omitted]aaaggtactgaattgcttatggatggaatgatatctgagattgggtccaaaataaatgatggatggcagatactgcccatgagttgataattatttagactgcatgacaggtgcaggaaggatcattatactattttatgtaattttatatgcatttgaaattttctggccgggtgcagtggctcactcctgtaatcccagcactttgggaggccaaggtgggaggatcacttgaggtcaggagttcgaaaccagcctggccaacatggtgaagccccatctctactaaaaacacaaaaattagccaggcatggtggtgggtgcctataatcccagctactcgggaggttgggacatgagaatcgcttgaacctgggaggcgga[138 bp omitted]ttcttcttttcctttttcttggctttctttgctctccttttgttatcttcatctgcaaattaaagcacattacaattaagaaaaaaattttttaactctaaaaccgtagtacttttgagtaggtaactatcctattgctgtcccatttattgttacaaagaaattacctcattgaaacatttattgctatttgtcacgaactgtagggaggtactatgaacatagaaattaaagtcactaggttttgatgatatagggtattattattaattttattgtgtgagatagtgtggtggctaattaggaaaatgcctctttttacgggatgcatacagaaatatttagggtggaagtgtgatgatatttgtaattaactttgactatctcagtgaaaaacccatatttgaagcaaatatgtaaaaataccaacaactgccaaatctaggtgattaagtatatggtattaattatactattctcttcgcttttctgaatatttaaatatttttgtgataaaaagggaaagaaaactatgtgtgtgttggagaggggagagagaatcctttcctggagctcagtctaatggaggagacagataggtaaagagatcaatacaatctggaatgatagagggaagcttggggaacctggacacacagaggagtctcaaaatcagactgatttgaggagggtggctgaggaatggttgatcaggaaaggtgactcttaaagtagttctttgattacaaaagtaatgcatgcccattggtgcaatgagtaaaccaagctggatggagggagagactggcattgtaggcagagggcctctctaccaagtaacaagagaaagaacatggaatactgaggagacagaaagtagttttcagattacagaggatgttgcaagagagtgtaacagggtatatgtgattagagagaaatgagtcagggtctgaactttaccctgaaggctatggagtgctattgaaggattttaagtaggtatttggtgtatagggtattattactaattttattgtatgagatagtgttgtagttaagtataaaaatgcctctttttaagtgttgcatacagaaatatttgaaagttctgtcttcgagcactgaggaagagaagtgacagggagggccaggaaacttcggcgatatcagaggaaggtgaatctttgtgtaatgtgttaacctcagaggaggcaccttctggtcaatcatcagccaggagagagtacaaaaaggagactctttgtgatgcactaccccagatagggtgccttccacaaataggcagccagcatgaagtaggcactttatggcatacctttttgaaaactgtagaggtgctcattgggcatgagaattaaacaaaagagcccttccactgggccgatgcagccctgtaaggcttactttggtacagcccaaccccctgacttggtctggtgccatgtgccttgtacactttgcacaaccaatcccaatccggagtcagattgcttaggtttgaatccaaactgtgtgaccttagggatagtacttataacctgctctgtctccatttcctcatctataagatgtaccctacagttattgtatggattaaatggcaataataaatataaagcacttattggggtacctggcacaaggttagcaagtgttcaaaaactcttcagtattattattgttttcaggaaccttcttctaaaataagttttaagaagtaaaactagttttgaagcaaggcttgcagaatgctgttggcgttcttaccactggagtctgtttcagaatcagagtcactgtcgctatcttcagaatacttcttatgttttcttttcgatgattttttctttctccttttcttggacctttcttttgaacggctagacttcttctttttttcttctaagaaagtacaaattaaaaaattatattctaaaaaactatttctgaacatcaaaagaaacagacgatgggcaatttgagtaaaagcaaagtctaatgttcaactatttacaaactgatttttttaaatctctcaataaaatagcttgtattttaaaaataccctttttttaaaaataccttctgaagtagaagctgaagtagtgcttttctttggctcttcatcctccactggtgtatgttcatcagaactgaatttaaataaaatggttataagaattaggaaagtgatgagatatggaccatggagtgtaaagatatgaactccaaatttttcagtaacagcatcgattgtccaagaaccattaaaagcaagcattggagatcctaaggcagaacttgggaatcaaaaaaaccaaaacaacaacaaagcaagcactgaactactttcataaacgtgcagttcaagggtctaccatctttgtaataataaaataacttatcatttgcataacactttagagtttacatagtactatttaaacaaagcagcatggaggatttatattttcacaagaaaccacagggaaaaagtagagaaacaggaaccataggaaagattaaagaaactgggtataagaaggctgaagaaagactttataattttattttaagcacgtaaaagacaaatggtaaagcagcaactgttctgtctcctcagagcaaaaacctaacaaactacagtctaaagagatgttgttctgttgcagagaattctgaaaatgagtattattcaaattctacaatagtttagaaaaggagtttccacatcatataatcttttcctctgaagatca[141 bp omitted]aaaccccatctctactaaaaatacaaaaattagccaggcatggtggcatgcacctgtaatcccagctactcgggaggctgaggcaggagaatcacttgaacctgggaggcggaggt[132 bp omitted]tcaggttcttcaagtgttttcttttttttttcttttaaatagtcttgttatttgcccaggctggtcttgaactcccgggctcaaggaatccacctgccttggcctcccaaagtgctgtgattacaggcgtgagccaccgcacctggcctcttcaagcattttctaaaggtatctgtaagaacaagtttcagataataatgctttattatccaatcacaaattacaggtttacctgtcaagcacattgtctcaactcaacctaaagttggcacagaaacagagagggaagaagaaacttatgagtagcatcaaagagaaaagaaataagcaaaaagaaaaagcattaagtctgcagatagtattggatataggaatattaacaa[136 bp omitted]tggtgaaaccgccgtctctactaaaaatacaaaaattagccgggcatggtggcaggcacctgtaatcccagctactcgggaggctgaggcaggagaatcgcttgaacccaggaggcggaggttgcagtgagctgagaccgcaccattgcactccagcctgggcgacagagcaagactccatctcaaaaaaaaaaatctctttgtaatgttaatatctggcatgcaatctgccactgagtttagttgagaaaaaataattcaaaataatgtgtattatttaacaatgaacccttctattaataggaaaattatattccaggaattattttagattatgctaaaacctactagcaacatgttttaatctttagatatgttctatgtttttaaaacttaaggggtagaagaacataaatcacaagaaagaaaaatgtgagatatatttaaagttcttcacttaaacattttcacaatagattcaggatttaaacacatattataacattttaaaaatatattttttaaccacttactctggttcaggattctttggagaaagtccccatacttcaggagctcccaattctccaattctctctctctcacttaatctcctagcagataaagacatgtaaattataactcaatggctgagttgtttcctaaatatataatcaaattcaataggagtctagttaagccttttttccctttatattttaaacatggataaaaacttggtttaaatgtaaactcatcacttaaggtctgatgttctgatgatactatcaaatggtacagactatagaaatgatggcctgggagactgtcaagtgcatccattctgctgaatgcatgacacagctcttaactgctcatttcatcatctgtaatatgtgacagaaacagcttcacatttgtaagtaacttcatttgtttacagatttatgaaaggtgaagagaagtctcttttgatatggtcaaaccttcagttttcagaaatcgaggaattaatgaagaaaataaaaatgatgcattagacgtagaaaacaactgaagttctg[134 bp omitted]tcctgcctcagcctccttagtagccgggattacaggcatgcgccatcacgcctggctaatttttgtattcttagtagagatggggtttcatcgtgttggccaggctggtctcaaactcctgacctcaggagatccacctcagttgctgggattacaggcgtgagccactgcaccgggcccgaaataaaagttttttatttttttgtagagatgaggtcttgccgccaggtgcggtggcacatgcctgtaatcccagcactttgggaggctgaggcgggcggattgcttgagatcaggaggtcaagaccagcctggccaacatggtgaaaccccgtctctagtaaaaatacaaaaattagccaggcgtggtggcgcatgcctgtaatcctggctactagggaggctgaggcaggagaatcgcttaaacccaggaggtggaagtttcagtgagccaagatcgcaccactgcactctaacctgggagacagagcgagactccgtctcaaaaaaaaaaaagaggtcttgctttgttgtccaggctgatcttgaactcctggcctcgagcaatcctcttgcctcagcctcccaaagcgttgggatcacaggcatgagccactgcacctagtcaaaaagtttcatttaacaaaaaatatacttggggctgggcgtggtggctcacgcctgtaatcccaacactttgggaggccgaggcaggtggatcacctgaggtcaggagttcaagatcagcctggccaacatggtaaaaccctgtctctactaaaaaaaatacaaaaattagctggacacggtggcatgtgcctgtagtcccagctattcagaaggctgaggctggagaatctcttgaaccctggaggtggaggttgcagtgagccaaggtcacgccactgcacatgacagcctgggtgatagagtgagactcttatctcaaaataaaaaaccaaaaaaaaaaaaaaaaaaactatactcaatgagatacaaggtttgttccctctctgttttccttttagttcctttttggaaaaggagtgcattttgtatctattctttgaaggacactaaaatttgtttcttcttttgttttatgcctatggtttcttctgttttaatttttgttattcctcataaactaaaaaacaaaacaaaacaaagactaaggctcattctctcaaattttagctgcttgtgactccatttgtttttaaaaatccttccaaaataaatataattgcaatgagtttttgtataaatcgtttttgcctccttaatcaggggaaaaggtattataactatgcagagtcagactgagagggtttcccacctgaagtaacagacaatttaaaaggtaacatatttatagctgtacttggaatgtatggatatcgggggaagaacgcctaccaggctgtaaatagcaggaagtcctgttgtcacctggtttcatctgtaatgttaagataaattattggccgggcccagcactttgggaggctgaggctggtggatcacctgaggtcaggagttcgagaccagcctggccaacatggcgaaaccccgtctctactaaaaacacaaaaattagctgggtgtggtggtgcatacctgtaatcccagctattcaggagattgaggcagaagaaccacttgaacccaggaggtggaggctgcagtgagccgagactgcaccactgcattccagcctgggagacagagtgagactccatctcaaaaaaaaaaaaaaagataaattatttattttctaaatgtacatatgcaagtttcatccaagcacttctgacatcttttggtgaggattctccaagaagaaactatttactttttgactgacatagcctgtgggtatgtttctgaaaaatgtaacttggagagatgggtctccaacctaactcaggactgtttttactgtttttgctcccatgcatgaaacattaatagctaacacttatggaatagttatgttccagccacttaattattacaatccccaaatccctagtacttattttatcccctttttaatccatagtacttattttatcccccttttaatgatgaagaaatggagcccagagaggttaagtaacttgaccaaggtcacacagctattaagtggcaaataaaggcttcatactcagtctgattctggagtttgtccttttcctttctttcttcctgttcttctctttgtttttttttgtttgtttgtttttgagacagcatctccctctgtcacccaagctggagtgcagtggtgagatcatggctcatggcagccttgacctctccagctcaagtgatcctcccacttcagcatccccagtacctgaaattacaagcacatgccaccacgcccagctgatttttaaaacactttttgtagagacagggtatccctatattgcctaggctggtcttgaactcctggattcaagtgatcctcctgccttggcctcctaaagtgttgggattacaggcatgagcctctgtgcccagccaaaaaatgcatagttttaaggagaaaggaaaaggctcataattattgctgtgtaagtcttaatatcttgtttattgttaaattatgtgtcaggcactgtactaagttatttacgtgcacttatatgtttaaaaaaatgagaaacttagaaatattacaggcattgagaggtaggttaaagttccaacagttgggagatgtcttgagtctttttcttccggcagtgggaggtaataaagtatagtgatgaaaaggacaggctcggcagggcatgtggggtcatacctgtaatctcagcacttccggaggccaacgtgggaggatcacttgagcccagaaattcgataccagcctgggcaacatggtgaaaccctgtctctaccaaaaaatacgaaaataagccgggtgtggtggtgcgcacctatagtcccagctatgagggaggctgaggtgggaggatcacttgagcccaagaaggtggaggctgcagtgagccaagattgcaccactgcactccaacctgggcgacagagctagaccctgtctcaaaaacaaaacaaaacaatccccaagctatgcatttttccactccaatactcactttgattagagatctagtctcatcctggcgtcatttttcgaggtcaagactgagaccacttaacaagaccttcctcaaagtggggtcatctatagcttatcagatcacttttcctacatgcatctaatcgtcttgtctgaggggaaggtttatttcctctccaacttaaacccttgatttcattccttcctaattccccacaaaacgtttctacataaatatcctgttatctcagacctgtaagttccttcattcaacaagcaatggttgagcgcctataaagtaccaggcacttagaattctgtgatcagaattctcctccgttcactggctcctcctttccatgagctcagtctagtggggaatacaaatatattcacgaatgataatgacacaaccaggtaaatgctacagttctggtaggtctgaactctcggcaatattcgctaacaagacaggaggcggaagggggtagcgggagaccagggcactatatgaaggggcctgagggtaagggaaaatgaaaaggacgaataaagggttgtcgtgggtggattaaagaaagggatgaaaatgggcgcaaggcaagcagagtgagcgaaatgcgaatagtcagaagcggaatgaatgatagatcggactccaaaggcacgtaggctcgtacaagagaaagtgcggccgtctcactcacttctgccgcaggctctcctccctctccttgtcgaggaggctaggccaaggcttgtcgctcccgtaggggcgcgagtagctgccgtaatagactgacgaggaggcagaagcgaaggggatgccccggggcgcagagggccgctctctagaacgcgaccgcgagcgtgagcggtaggactggtttcgggagccttggctgaggccacccagctgatgggtgagtccattccggtccccggaccgagagcaagagtgcgagcgagagcggcggccccgcggggagcgggcagatttgctgggcttcggactcttcgacgaactgcgacgtcttccccccgagcccgaggcctccctatccgggctgcgtgagccggacaccggagccatggctactggggggccccagcagccgtgggacaagggggcgctctcgcgagcctaggaagatgtctgttgccttggttcccgggacctgccgctgcggaacagcccaaatctgaggaaaccttggacacagttctgggtacttctgcaaaacccttccccggatctaggcggtcgtcaccgacaggaagcgatgtgtgcatcaatataaataagccggtggggcaactagattgcgtgcatccttccagttccgagtgaggctcctcaagtctaagcaagagaccaagttctttctcagccttgaacttgaaacacttgaagggaagtatatatttcaaacacaatatacagtatacatttcactgagtggccgtatgaacaagacagttaattctgcttgtgtttcctgtgctttctgtgtgtatttatatataaatgtgtgtgtgtgtgtgtatgtcatgtatgaaagtatgaatgtgtattttctttttctttccaatcccaagcaaatcgggagggtttttcgcgactggggattagctatggtgtctaagccccatattgccgtgttagcttagagggcgcaaattttgttaatgactcgcgcctgataaacttcaattaagtttcccgcctagagaaaaactgcatacttatcccctagccaccgtctccaccaatatgccccagcaaaaggaggttttttttttttgagactggaactcactctgctcactctgtcgcccaggatggagtacagtggcaagatctcagctccctgcaaacctccgcctccccgggctcaagctatcctcccacctcagcctcctgaatagctgggattacaggcgcatgcgacaccaagcctgggtagttttttttttgaggggggtcgggggaaacagggtttcaccttgttgcccaggtggtcttgaactcctgggctcaagcgatccgccagcctcggcctcccaaagtgctaggattataggtgtgagccactgcgtctggcttgtatttttttccccaaaaagtgtcattttattttttatttttttatttttgagacaagggctccctctgtcatccaggctggagtgcagtggctatcctggctcactgcaacctccgcctcccaggttcaagtgattctcctgcctcagcctcctgagtagctgggattacagacatgtgccatcatgcacagctaattttttattattttttaaatttgtacaaatctatgggatacatgtgaaattttgttacatgtatataatgtgtagtgatgacgtcagggtatttaaggtgtccattatctgagcacaatacatttttgttaagtgtactctcggcctggtatggtggctcacgtctgtaatcccagcactttgggaggcagaggcgggtggatcacttgaggtcaggagtttgagaccagcctggccaacatggcgaaaccctgtctccactaaaaatacaaaaattagctgggcctggtggcacgtgcctgtaatctcagctactagggtggctgaggcacgagaatcgcttgaacccgggaggctgaggttgcagtgagccgagagtgagattgcaccactgcactccagcctgggcaacagagtgagactgtgtttccaaaaaaaaatagtgtactctcactctaccatgctgtcaatatcaaacattgaatttggggctgggcatggtgacttacacctgtaactccagaaatttgggaggccgaggcgggccaatcacttgagcccaggagttggagaccagcctgggaaacatagggagaccctgtctctacaaaaaatttaaaaatttggcgagtgtggtggtgcatgccagctactcaggagactgaggtgggaggaacacttacttgagcccggaaatcgaagttgcagtgagccgtgattgatccactgcactccatgggcgacagagtgagacactgtcttaaaacaacaacaaaaaccattgaatttatttcttctatcttactgtatgtttgtaccctttaacctatttctcttcatccttctgcttcctcccacataccctacccagcctctattatctatccagcaaaaggaatttgtaatcccctctttgtccagctccttaaactagtctcattgtatgccagcccagcaatatagagttaaggatcagtattcctattctttttttttttttttttttttttttacatggagtctcgctctgtaagcaggctggagtgcagtggcgtgatcttggctcactgcaatctctgcctctagggttcaagctattttcctgcctcagcctcctgagtagctgggattacaggggcgtgccaccatgcccagctaatttttgtagttttagtagagacagagtttcaccatgttgg[131 bp omitted]ttgtgaaacagtgtctggctccctcacccagactggagtgcagtggtgtgatcttggctcactgcaacctccacctcctgagttcaagggatcctcccacctcagcctcctgagtagctggcatgtgccatggttcgctaatttttaaattttttgtagacatggggttttgccatgttgcccaagctggtcttgaactcatggactcaagtgatcctcacacctcggcatctcaatgtgctgtcattacaggcttgaaccactgcacctaggcctctactgtttttaaatcaaagggcattccaacattaattctactgatttcgacttttttttttgagacagagtcttgctctgttgcccaggctggagtgcagtggcaggatcttggctcactgcaacctctgcctcctgggttcaagcagtcctcatgcctcagcctcccaagtagctgggattacaggtgcccaccaccatgcccaggtaatttttgtatttttggtagagactgggttttaccctgtaagccaggctggtctcaaactcctgacctccaatgatctgccggcctccgcttcctaaagtactgggatcacaggcgtgagcctccatgcacagccctcaatttggatttttgaaggtacataggtttgctgaagaaattccaagtccagcctgccagtagcatgatggcctctgggattttcctaagaagtaatttatcagatcatgaaaattaatgccaattgattatcagaaatctcctttttttggaatttaagggaaagacgtatgaaataatgttaaatggaaagagtggaccacactattggatatcttctatgtataactaatttgtcatggggccaggtccaaaaacttaatcgagtaagagaaattctgtgatttgggatggagattggggagaatttctaataagaaagttttcaatggaaaacctactgcctaacttttgcgacaacaggcagtacaccttcacatcagttgcctataaaaccaactctgcaacagtgattggtctacctgccccatggctggtggacatgtactttagttggaaagagaaaacccctactcctgcacatctgaatggcatggtgctcttcttgccaggtatcctgggagcagcctgtgtttcatgagttggcagtgagggggagctagagcacacagggaggtgcagacagccagtgggatcaggcttgcagagtttgggtcctgccactgcactccagcctgggcaacctctgcctcccaggttcaagtgattctcctgcctcagcctcccaagtagctgggacttcaggcatgcgccaccatgcccagctaatttttgtatttttagtagagacaggatttcactgtgttggccaggctggtcttgaactcctgacctcatgatccgcctgcctcaccctcccaaagtgctgggattacaggcatgagccaccgcgcctggcctattcttctttaaattttttttttttgagatgggggtctcactctgtcacccaggctaaagtgcagtggcactatcttggctcactgcaacctccgcctcctgggttcaagcgatcttcccacctcagcctcccgagtagcggggacaacaggcgcataccaccatgcctggctaagttttgacatttttggtagagacaaggtttcgccatgttgcccaggtgggtctggaacccctgagctcaagtgatccgcccacctcggcctcccaaagtgctgggatcacaggcgtgagccacctcacctgacctgatccattctctacaggaattaaaccatttgtgtgttatgggatatggaggtattcagcttccattcactactcctcttcaaagtctgagactctgcagctgtctgggcaggtgcatggctaacacccagcggactgaggcagggatctgggttgtggaaatggaatttaaggagtgggtgttagggggactcttgtagtttgtgtccatttgaatttgaggatgctttccaattatgccaacaattgttttagagactgcgagattaaaacaatgtttttaatcactaacctcttttgaaagaatttgcaggatcaaaacccgaactacataatttctaaaaagaattttcttttagaatacttcttagtcaatacagacctgtgatccctgataacttaactggcgtgctggctttgtcagttcctctaacacctcacttatctgcatttcttctctgataatgaattgctactacttctacaggaagaaattggatgatattaggcccctaaatatggaaaatttcgcactcttgggttagcctatttgaatctcacattggaaagactgtcataaatggagaactgtttctaatttgactccactaggaggagctgtatctaccaacaggtagaaatatggctggaacttgcaggtgtgttctgaggaccaaaagcacaggataaaataagtgatgtgaccattctaggatatattcgagctaaagatcgtgtgtgctcatgcgcacccaaaagatagagagaggaacattgaatgaagcagagctcagtgctagacatggatggagaatttgagtgctctgctgcccaccgggtccctaggggactaggatgttagccagggggcgaggccgccccaaaacttggccaaacaactgatatcctaaagcacagccaataatcacaatagacacaatagttgtgtcacagattccaaatacaattgaacagcttccagtttgcgtctatgtgagaaggggcaaaaaagggaaagagggttgatcacagagagaagtaagatataaccctctgttcctgtgttgcttaactccaattaactgacattccttatttgcagtatctagagtacaaaactttggtgctgatagtgagaaatcaacgtgccgcacatttgctattcctgtaagggcaaatgttaaatatgggactgtggcatttgattccctcatgctccccccttcttttcctcctccttcccttctgtcccttccccctctcttcctgtagctttaaaaatgaaagaacaggacttcctcagaatgcagttttgcaaaatttaactaaacactacatgaagtactcgtatctattatcggataagccatgctaataaactgaaaacccaaaataggcacaccctgaaaacattggactcagtgagcagagatgctagctgtagtcatgctttgatcttgccttgtttttttttttaattaatagactttatttttaagagcagttttaggtttacagaaaaatggagcagaaagtacagagctcccatatactccccctgccctgccccactccacctccacagtttcctctattatgaacattttgttttggtatggcacatttgtttttttgtttatttgtttgttttttaggcggagttttgctcttgtcgcccaggctggagtgcaatggcgcgatcttggctcactgcaacctctgcctcctgggttcaagtgattctcctgcctcagcctcccaagtagctgagaccacaggcatgtggcaccatatccagctactttttgtattattaatagagacggggttttaccatgttggccaggctggtc[137 bp omitted]atgataattaactaaagtctgtagtttacattagggttcattctttgtgttctactttctatggattttgccaaatgcataatgtcatgtacctaccattacatcatcatacagagcagtttcactacctttaaaatctctctgtgctctacctattcatccttccttccttaccctctcccttcttccctgccaaacttctggaaactgctgatctttttactgtctctacagttgtactttttctagaatgccatagtattagtcagggttctctagagggacagaactaattatatatatacatatatatgtgtgtgtatatatgtatacatatattgtgtatatacacacatatacaatatatgtgtatgtatactatatgtatatatagtatatatgtatatatgctgtatatgtatatatatactatatatgtatatacatatatattagcagtagaactaatagtactatatatatgctattagtagaactaatagcatatatatatatatatatatatatatatatatatatatatatggagtttattaaggagtattgactcacatgatcacaaggtgaggtcccacagtaggctgtctataagctgacgagcaaggagcctactccaagtcccaaagctgaagaacttggagtctgatgttcaagggtaggaagcatccagcacaggagaaagatgtaagccagaagattaaaccagtctagtctgttcttctgcctgcttttattctggccccctggcagctgattagatggagcccaccctgactgagggtgggtctgcttctcccagtccactgactcaaatgttaatctcctttggcaacaccctcatggacacacctaggaacaatactttggaacattcttcagtgcgatcaatttgacactcagtattaaccatcacagccatatatttgcaatcagactggcttcttccacttggcaatgtgcatttcacattcctccatgtcttcttgtgacttgacagttcatttctttttagtgctgaataatattctattgtatggatacaccacaatttgtatatctattcacctattgcaggacatcgtgattgtttccaagttttggcaattatgtataaatctgctataaacatttatgtgtaggtttttgtgcagatatatgttttaaccttacttgggtacatacctagaggtgtgattactggatcatatggtaagacgatgtttagccttgtaagaaactaccaaactgtctttgaatgtggctgaaccatttggcattcccaccagcaatgaatgaaaattcttgttggtctacattcttgtcagcatttggtgctgtcagtattgtggattttggccattctaatagctgtgtagtggtatctcattttaattttcaatttgcaaactacatatgatgttgaacatcttttcatgtgcttgtttgccatgtgtatgtcttcttttggttcacatctttttaattgggttattttcttattgttgagttgaagagttccttgtgtattgtggatacaagccttttatatgtattttgaaaatacttcctttcagtcagtggcttgtattttcattctctctctctctctcttttcttttttgagacagagtcttgctttgtctcccaggctggtgtgcagtggcacaatcttggctcactgcaacctctgcctcctgggttcaagcgattctcctgcctcagcctcctgagtagctgggacttcaggtgcccgccaccaggcccgggctaatttttgtatttttagtagagacagggtttcaccatattggccaggctggtcttgaactcctgaccttgtgatctacctgccctggcctcccgaagtgctgggattacagtcatgagccactgcgctcagccccattctcttaatgatgttttttgtaggacagatgtttttaatcctaatgaagtccaagttatcaatttttttttcatggaatattctgtttgctttttacctaaaaacttattgacaaaccccaagtcacccagattttttcatatgttatcttcttgaagttttatagctttacattaatttttttttttttttgagacgaagtctcgctgtgttgccaaggctggagtgcagtggcgagatcagggctcactgcaatctccacctcctgggctcaagcaatcctccacctccgccttctgagtagctgggactacaggcaggcgccaccatgcctggctaattttttttttcttttggtagagacagggttttgccatgttacctaggctggtctcaaactcctgaactcacgagatccagccgcctcagcctctgaaattgctgggatttcaggtgtgagacactgcacctggcctagttttacattttatatttaaatctgtgatccattttgagttactctttgtgaaaggtgtaagattcatttttttgcatgtagctgtccagtttttccagcaccatttgttgagaagactatcctttctccattggattgcctttgttcctttatcaaagatcagttaactatatttgtgtgggcctatttctgagctgtctgttatgtctcatcaatctattctttcaccaataccccactgtctagattactgtagctttataatagtaatatcttgttgttgggaaatgtcagtcctctcactttattcttattcttgagaattaatttggcaatttctgggtcatttgattttttatataaactttaaaatcagttagttgacttccacaaaatgatttgcagggattttgatgggaattgcattcaatctacaggtcaagttgggaagaagtgacatctaaacaatattgagtcttcctattcgtgaacatagaatctctcttcatgtatttatttatttttattaaattttttaccttgcagctcaaaggatctccatttagatctttgatttatttcatcagagttttgtagttctctgcatatagatattgagatataacacatattttgttatgttatacctaagtatttaattttttggtgctaatataaatggtattgtgtttttaatttcaaattccagttgctcattgctgacatataggaagatgattgacttttgtatattaaccttgtgtcctacaatcttgctataattgctcattagtttcaggagtgttattttttattgttgttaattccttgggattttctacacatataatcatgtcatctgtgaataaggacaattttatttttttcctctcagttcatatactgtttattttattttattttattattgcattaggcaggacttccaggacaattgtgaattggagtggtgagaggtgatgcctttgccttgttcctgatcttaaggggaaaacatctagtttctcaccattaagtgtaatgtaggcatttttagatgtccttatcatggtgaggaacttactctctcttcctgggtttctgagagttcttaacatgaatgggtgttggattttgtcaaatgcttttttctgcatctgttgatatgatcatgttatttttcttctttagcttgttaatgtgatgggttacattaattggttttcaaatgttgaaccacctttgcatgcgtgaaataaattccacttagttgtggtgtataatttttttgtatacattgctgaatttgatctaacattttgttgaagattttacatctatgttcatgggagatgttcatttgtggttttccttgcttgtaatgcatttgtctgattttgatatttgggtaatgctaacctcagaggatgagttaggacgtatttcctatgcttctattttttagaacagattgtagagaattagtataatttcttccttaaatgtttggtagaattccccagtgaaactatcttggccaggtgctttctgttctggaagattattgattcaattaaaaatacatatagatgttgagattgtctgtttctccttgtgtgagttttagtagattgtatctgttgggagaaaagctgagtgtagggagaaaagctgagtgtagggagagaagctgaggcagggcttgcatgtctgctagacttgctggctccttacttctagcactcccattatcccaagtagccatatgtttttcattcacttgatacactgtttcctttcaacccccacatcctcaccacctgtttctttgagcactaataaatagcgtgggctcccagagctcagggcctttgcagcctccacacttgtgatggcccccggtcccactttctctcaaactgtctttttctcaatcctttgactccactggacttcatcgtccccacaacctggtgttgggtctgatcatcccaacagtatctttcaaggaattggtccattgcatctaagttattaaatttgtggccataaagttttgcaaaatattcctttctcatcattttaatgtccatgagatcggtagtaatgacctctctttcatttctgatattagaaatttgtttctgggcatggtgtctcatgtctgtaatcccagcactttgggaggctgaggcagaagatcccttgagcacaagagtacaagtttacagtcagcctatgattgcatcactgcactctagcctgggtgacagagcaagacttttgtcttccgccaaaagaggaaaaaaaattatgttttgtctcttttttcccttggttaccctgacttgatatttaccgattttgtgatcttttcaaagagccaacttttggttttgttgcttttcttgttttctgttttaaatttccttgatttttgctctgagtttttattccattttttcttctgctttcttttcattcaatttactcttctttctctagtttcttaaggttgaagtttagattatgaattttagttcctattttttttttttttttggcagagtttcgctctgtttcccaggatggagtgcagtggcacaatctcggctcactgcaacctctgcctcctgggttcaagcaattctccagcctcagcctcccgagtagctgggactacaggcacgtgccac[131 bp omitted]ccggccctgtttttctaatgcatgcactaagtgctaatgaattttcctctatgcattgctttcattgattaccacacattttgaaaagttgtattttcattttcacgtagttcaaaatatttttcaaattcccctgaaatgtcttctttgatccatgtgttctttagaagtgtgtcttatggcaaagaagtggtctaccttgctgaatgtcccatgcgagtttgagaagaatgtgtattctattgtaggataaaatgctctataaatgtcaactagatccagtttattgatggttcaaccatatccttactgattttctgcctgctggatttgtcaattactgatgttgacgtgttgatgtctccaagtataatagcgggtttagctcattctccttgcagttatgtcagttttcgccgcacatatttggatactctctcattagacacatacacattaaggattgttctgttttctggagaattgactcctttatccttatgaagggcccctctttatccctaataattttccttactctaaggtttgctttgtctgaaattaatatagctactccggctttctttttctttttcttttttgttttttgagacaagagtcttactctgtcacccagattggagtgcagtggcatgaccttggctcactgcaatctccgcattccaggtttaagcgattctcgtgcctcagcctcccaagtatctgggactacaggtgcatgcaactgtgcccggctaatttttgtatttttagtagagatgggaggtttcactatgttggttttcactatgttggccaggctggtctcaaactcctggcctcaagtgatctagccgcctcagcctcccaaagtgctggtgtgtctggaatttgttccttccagtgggttcttggtctcgctgacttcaagaatgaagccgcagaccctcgtggtgagtgttacagttcttaaagatggtgtgtctggagtttgttccttcagatgttcagatgtgtccagagtgtcttccttctggtgggttcgtggtctcactgacttcaggagtgaagccgcagaccttcgcaatgagtgttacagctcttaaaggtggcacgtccggagttgtttgctcctcctggtgggtttgtggtcttgctgacttcaggaacaaagccacagaccccggcagtgagtgttatagctcttaaaggtggcgcacgtccagagttgtttgttcctcccagtgggtttgtggtctcgctgacttcaggagtgaagccgcagaccctcgcggtgagtgttacagctcataaaggtagtgcatacccaaagagtgagcagcagcaagatttattgtgaagagcaaaagaacaaagcttccacagcgtggaaggggacctgagtgggttgccgctgctggctcgggtggccagcttttattcccttatttggccccactcacatcctgctgattgatccattctacagagtgctgattggtccgttttatagagtgctgattggtccattttacagagtgctgattggtgtgttttcaatcttttagctagacacagagtgctgattggtgcgtttttacagagtgctaattggtgcatttacaatcctttagctagacacagagtgctgattggtgcatttttacagagtgctgattggtgcatttacaatcctttagcaagacagaaaaattctccaagtccccacctgacccagaagtccagctggcttcacctctcactgggattacaagtgtgagccaccgaacctggcacagctttcttttgattagtgctactatagcataatctttctccatcctttttcagaaaaaactcctgtctccaaatcaaaaccattcttttacttttgatccatgtctttatattttatttatttatttatttatgagacaaggtctcactctgttgcccaggcaggagtgcagtggcgtgattatggctcattacaacctcagcctccctgggctcaggtgatcctcccacctcagccttctgagtagctgggactacaggcacaggccatcctgcttggctaatttttatattagcaggggttttgccatgttgctcaggctggtcttgaaatcttgagctcaggtaatctgcctgcctcagcctaccaaagtgctgaaattacaggtgttaactaccacacctggcctgtttttgtatttaaagtgagttttttgtagccagtatagagttgggtcttgtatttttatccactctgagtgtttctgtcttttttttcctcttcatgctcatatcatgaagtttctgtctgtcttttaatttgtgtatttagatcattcacatttaaagtgattattgatgtatttggattagtgtctaccatatttgtaactattttcaatttgttgcctttgttcttggtttctattttgtcttttactctttttctgccttctttggttgtaattgagcttctaattatgattccattttctctcctctcttagtatatcagttatacttcttttttaaaattttatttaatggtttgtgtgtgtgttttctttttcttttcttttttttttagggtaaggtctcactctgtcactcaggctggagtgcagtggcacgatcatagctcactgcagccttgacctgctgagcttaagcagtcatcctgtctctgcctcctgagtagctggcagtacaggtacacgccaccacacatggctaattatacttcttaaaaatatttttagtgttgccctagtgtttgcaatatgcatttactactaatctaagttcactttcaaataacactatatcattgtatgggtagtacaactattttataacacagtattcccaattcctcccttataacattgctgtcctttataacattgctgtcattcatttcacttatctctaaactataatcactgaacccattgtttctataattaatttgaacactgttatcagttagatcaaataagaaaaatgagatatttattttattttacctttatcgatgatttctctaatgtttttcctttctttatgtaaattggagtttttggtttttttttttttttgagtctcgctcttgtctcccaggctggagtgcaatggcgtgatcttggctcactgcaacttcctggcttcaagtgattcgcctgcctcagcctcccaagtagctggcactacaggcacctgctacgacgcccagctaatttttgtatttttaggagagatggggtttcaccatgttggccaggctggtctcaaactcctgaccccaggtgatctgcctgcctcggcctcccaaagtgctggaattacaggcctgggccactgtgcccagccgatcatttttctattctttgaaaaacttttggccgggcgcagtggctcacgcctgtaatctcagcactttgggagg[134 bp omitted]gactgaggtaggagaatcacttgaacccgggagttggaggttgcagtgagccgagatcgtgtcactgcactccagcctgagtgacagagcaatactctgtctaaaaaaaaaaagaaaaaaaaaaacttttaacatccattgcaaagcggttatactggtgacaatttctcccagttttgtttgtctgagaaagtctttatcctcttgaagggtaatatcactgggtgcagaattctaggttgttggtgcttttctttgaatacctcttcttgctcctctataggtaaggtattgttttcatccatcttcttttaagagtttctctttgtctttgattttctatagtttgaatatgatatgcttaaatatagattattttggtatttattctactagatgttccttgactatattggatctctggtttgctctctgtattaactttgaaaaattttctgccattattatgttaattatttcttccattcctttctctcttctctcattatgcatatgttacacctttgtaattgtccagagttctttgatattctgtttgttttttgtttcattattttttctctttgcttttcagtttgggaaattcctattgtcatattaagagcttttcttttcttttcttattttactttatttttgagacagcgtctcagtctgtcatccaggctggagcacagtggattgatcatagctcactgcagcccccaacaccagggctcatgcaatcctaccgtctcagccaccacacctggataattttgtttaagagatggggtcttgctatgttgcccccgctggtctcaaacttgcctgcagcaatcctcccactttagccccatgaagtgctgggcttacaggtgtgagccaccgtgtccaacccacatatggaagtctattgtcatatcttctagtgtactgtttctttcctgccttctctagtctaaccataagcccatcagagcattcttcaattctgttactatgtttgtgatttgtagcatttcttttttaatttttttcttagagtttttatcactctatacattactcatctttcttgcatgttatctgctctttccaatagagcacttagcataataatcatagttattttaaattcccaacctaatcattctaaaatctgtgctgtattttagttgggttctgatgcttgcttcgtctcttcagaacatgatttttttgagacaaggtctcactctgttgcccagggtgaactgcagtggcatgatcatggctcattgcaacctcctgggctcaagcgatcttcccacctcagtttcccgagtagctagggtctacaggcatgtgccaccatgcctggctaatttttcttattttttgtagagacaaggtctcactatgttgtccaggctggtctagaacttctgggctcaagtgtttcacttgctttgacctcctgaagtgctgatattaaaggtgtaggccactgcacctggttctagaatatgttttttgagttttagcagtcttatacatttttgttgaaaaccatacatgatgtactgggtagaaagaactgaggtaggctgggcatggtggctgtgcctctctattcccagcacttcgtgaggccaagtcaggaggcccacttgaggccaggaattcgagaccagcctgggcaataatatagtgagaccctgtcactacaaaaaaaggaaaaataaaaaagcactgaggtaggtagttcttttgtgtgaggttttatggttctctggctaagaattatgctgtttactgttggccgtagctttaagtgtcagaagctaaaatttcttgtagggcccttgtctttgtcttctttgttgtctttgagtttttccagaggctccttaaataggatctgaggcttgcagtcttttcagctgtaattcacttataatctgtggttattatgcaggattcttactgatgtggtggtaaggttgggaggagcacaagcattctatcatcccatgattagatctcagtctttcactgagcctgtgtccctgggctgtgacctttacaagtccttctcagtgtccccacccatccctttagcctagatggaaggctagacagggctggagtttagtacttcctttccctgtgtttggtcaggctttggggaaacagaacttggttaggctctggtaaaatagtttcctctcagggtagtccttggctagggaaaacagagatctctgggcatatttcaaaatgattgcttttcttgtctacctgctggaagcagagagggattcccaccccctcccttcacagtgacgacttggtggggcttctggagataaaactcatgaaagtgtggagtccccttaaagctgcccccacccttgaagttttaactctctagataggccatactgagcttctagaagttcatcagaacagttgttcctacagagtgttcctactcgtactggctccaactgtgggtttctgctgatggccttctactcttggtaaatggtaattctctgtatctgcctgtctgtctctagttttcatgccttccactgtaattctctgatatatctaggaagagttatttttagtttgttcagcttttttcttgtgaggacaggaatgatgacttccaagctctttacgtgttggactgcaaacgcgcaagtccttgtcttgctgtttaaagtgtgagaatttgaggtttccaagatggccgaataggaacagttccagtctacagctcccagtgtgagtgacgcagaagatgggtgatttctgcatttccaactaaggtaccggattcatctcaatggggcttgtcagacagtgggtgcagcccacggagtgtgagccgaagcagggcagggcatcgcctcacttgggaagtgcaaggggttgggaaattccctttcctagccaagggaagctgtgatagacggtacctggaaaatcaggacactcccaccctaatactgcacttttccaatggtcttagcaaacagcacaccaggagattttatactgcgcctggctcggagggtcccacgcccacggagccttgctcactgctagcacagcagtctgagatcaaattgcaaggtggcagtgaggctgggggaggggcgcctgccattgctgaggcttgagtaggtaaacaaggcggccgggaagctcgaactgggttgagcccaccacagctcaaggaggcctgcctccctctgtagactccacctcttggggcaaggcatagctgaacaaaaggcagcagaaacttctgcagacttaaacgtccctgtctgacagctttgaagagagtagtggttctcccagcatgcagtttgagatctgagaatggacagactgcctcctcaagagggtccctgacccccgagtagcctaactgggaggcatctcccagtaggggctgactgacacctcatacagctgggtgcccctctgagacgaagcttccagaggaaggatcaggcagcaacatttgccatcctgcagtatttgctattctgcagcctgtgctggtgatacccaggcaaacagggtctggagtggacctccagcaaactccaacagatctgcagctgagggtcctgactgttagaaggaaaactaacaaacagaaaggatacccacaccaaaaccccatctgtacgtcaccatcatcaaagaccaaaggtagataaaaccacaaagatggggagaaaccagagcagaaaagctgaaaattctaaaaatcagagtgcctcttctcctctaaaggaacacagctcctcaccagcaatggaacaaagctagatggagaatgactttgacgagttgagagaagaaggcttcagacgatcattaataacaaacttctccgagctaaaggaggatgtttgaacccatcacaaagaagctaaaaaccttgaaaaaagattggaggaatggctaactagaataaacagcatagagaagaccttaaatgaattgatggagctgaaaaccatggcacgagaactacgtgacgaatgcacaagcttcagtagccaattcgatcaagtggaagaaagggtatcagcgattgaagatcaaatgaatgaaataaaatgagaagagaagtttatagaaaaaagagtaaaaagaaacaaacaaagcctgcaagaaatatgggactatgtgaaaagaccaaatctatgtctgattggggtacctgaaagtgatggggagaatggaaccaagttggaaaacactctgcaggatattatccaggagaacttccccaacctagcaaggcaggccaacattaaaattcaggaaatagagaatgccacaaagatactccttgagaagagcaactccaagacacataattgtcagattcaccaaagttgaaatgaaggaaaaaatgttaagggcagccagagagaaaggttaggttacccacaaagggaagcccatcagactaacagctgatctctcagcagaaattctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccggtaccagtcactgcaaaaacatgccaaattgtgatgaccatcgatgctaggaagaaactgcatcaaataacaagcaaaataaccagctaacatcataatgacaggatcaaattcacacattaccatttttttttttttttgagacggagtctcgctctgtcacccaggctagagtgcagtggcgcggtctcggctcactgcaagatccacctcctgggatcatgccattctcctgcctc[224 bp omitted]gctccaattaaaagacacagactggcaaattggataaagagtcaagacccatcagtatgctgtattcaggagacccatctcatgtgcagagacacacataggctcaaaataaagtggtggaggaaaatctaccaagcaaatggaaaacaaaaaaaagcaggggttgcaatcctagtctctgataaaacagactttaaaccaacaaagatctaaagagacaaagaaggccattacataatggtaaagtgatcaattcaacaagaagagctaactatcataaatatatatgcactcaatacaggagcagccagattcataaagcaagtccttagagacctacaaagagacagagtcccacacaatagtaataggagactttaacaccccactgtcaacattagacagatcaacgagacagaatgttaacaaggatatccaggaattcaactcagctctgcaggagctggtttttttgaaaagatcaacaaaattgacagaccactagcaagactaataaagaagaaaagagagaagaatcaaatagacacaataaaaaatgataaaagggatatcaccactgatcccacagaaatacaaactaccatcagagaatactataaacacctctacacaaacaaactagaaaaatctagaagaaatggataaattcctggacacatacaccctcccaagactaaaccaggaagaagttgaatccctgactagatcaataacaggctctgaaatagagacaataattaatagcctaccaaccaaaaaaagtccgggaccagacagattcacagtcaaattgtaccagaggtacaaagaggagctggtaccattccttctgaaactattccaatcaatagaaaaagagggaatcctccctaactcattttatgaggccagcatcatcctgataccaaagcctggcagagacataacaaaaaaagagaattttagaccaatatccctgatgaacatcgatgcaaaaattctcaataaaatactggcaaactgaatccaggagcccatcaaaaagcttatccatgatgatcaagttggcttcatccctgggatacaagtctggttcaacctatgcaaaccaataaatgtaatccatcatataaacagaaccaaagacaaaaaccacatgattatctcaatagatgcagaaaaggcctttgacaaaattcaacagcccttcgtgctaaaaactctcaataaactgggtattgatgggacgtatccaaaaataataagaggtatttatgacaaacccacggccaatatcagactgaatgggcaaaaactggaagcattccctttgaaaactggcacaagacagggatgccctctcaccactcctattcaacatagtgttggaagttctggccagggcaatcaggcaggagaaggaaataaagggtattcaattaggaaaagaggaagtcaaattgtccctgtttgcagatgacatgattgtatatttagaaaaccccatcatctcagcccaaaatctccttaagctgataagcaacttcagcagtctcaggatacaaaatcagtgtgcaaaattcacaagcattcctatacaccaataacagacgaacagagagccaaatcatgagtgaactcccattcagaattgcttcaaagagaataaaatacctaggaatccaacttacaagggatgtgaaggacctcttcaagcagaactacaaaccactgctcaacgaaatcaaagaggacacaaacaaatggaagaacattctatgctcatggataggaagaatcaatattgtgaaaatggccatactgcccaaggtaatttatagattcaatgtcatccccatcaagctaccaatgactttcttcacagaattggaaaaaactactttaaagttcatatggaaccaaaaaagggcccacattgctaagacaatcctaagccaaaagaacaaagctggaggcatcacgctatgtgacctcaaactatactacaaggctacagtaaccaaaacagcatggtactggtaccaaaacagagatatagactaatggaacagaacagagcccccagaaataataccacacatctacaaccatctgatctttgacaaacctgacaaaaaaagaaacagggaaaggattccctatttaataaatggtgctgggaaaactggctagccatatgtagaaagctgaaactggatcccttccttacaccttatagaaaaattcattcaagatggattaaagacttaaatgttagacctaaaaccataaaaaccctagaagaaaacctaggcaataccattcaggacataggcatgggcaaggacttcatgactaaaacaccaaaaccaatggcaaccaaagcaaaaattacaaatgggatctaattaaactaaagagcttctgcacagcaaaagaaactaccatcagagtgaacaggcaacctacagaatgggagaaaatttttacaatctacccatctgacaaatggctaatatccagaatctacaaagaacttaaacaaatttacaagaaaaaaatcaaacaaacccatcaaaaagtgggagaaggatatgaacagacacttctcaaaagaagacatttatgcagccaaaagacacatgaaaaaatgctcatcatcactggccatcagagaaatgcaaattaaaaccacaatgagataccatctcatgccagttagaatggcaatcattaaaaagtcaggaaacaacaggtgctggagaggatgtggagacatgggaacacttttacactgttggtgggactgtaaactagttcaaccattggggaagacagtgtggcgattcctcaaggatctagaactagaaataccatttgacccagccatcccattactgggtatatacccaaaggattataaatcatgctactgtaaagacacatgcacacgtatgtttactgtagcactattcacagtagcaaagacttggaaccaacccaaatgtccatcaatgatagactggattaagaaaatgtggcacatatacaccatggaatactatgcagccataaaaaaggatgagttcatgtcctttgtagggacatggatgaaactggaaaccatcattctgagcaaactattgcaaggacagaaaaccaaacactgcatgttctcactcataggtgggaattggagaatgagaacacttggacacaagatggggaatatcatacactggagcctgtcatggggtggggggagggggggagatagcattaggagatatacctaatgtaaatgacaagttaatgggggcagcacaccaacatggcacatgtatacatatgtaacaaacctgcatgttgtgcacatgtaccctagaacttaaagtataataaaaaaaataataataaagtgtgagaatttggccaggcacagtggctcagccatgtaatcccaccactgtgggaggctgaggcagatggataacttgaggtcaggagtttcagacaagcctggttaacatggtgaaaccaagtctccactaaaaatacagaaattagcagggcatggtggcacttgcctgtaatcccagctacttgggaggctgagggaagagaatggcttgggccaggcgcagtggctcatgcttgtaatcccagcactttgggaggctggggcaggtggatcacttgaggccaggagtttgagaccagcctggccaacatggcgaaaccccatctctactaaaaatacaaaaattagccggatgttctggcgggcgcctgtaatctcagctacttgggtggctgaggcaggagaatcacttgaacccgggaggcagaggttgcagtgagtggagatcacaccattgcactccagcctgtgcgacaagagtgaaactccatctcagaaaaaaaaaaaaagaatcacttgaccttggagatggaggttctagttagctgagatcatgccactgcaccctagcctgggtgacagagtgagactctgtctcaaaaaaataaataaaataaagtgtgaggaaccagttagaatggcaatcattaaaaagtcaggaaacaacaggtgctggagaggatgtggagaaataggaacacttttacactgttggtgggactataaactagttcaaccattgtggaagtcagtgtggcgattcctcagggatctagaactagaaataccatttgacccagccatcccactactgggtatatacccaaaggactataaatcatgctgctataaagacacatgcacacgtatgtttactgcggcattattcacaataacaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataaagtaaaaaataaaaaaataaaaaaaaatttaaaaaaagtaaataaagggtgaggattttagacttccatgatgttgtacactcatcatacactgcttcacacagggaaaaggacgttgtgttttctttgataaatagcagcttaatccactgttaattgttttaaagaatcacttttcatttttattttcttattgtattatatgcatcttatgttatatattgccttaatttttaagatgacagaataaatggatgaataaatgaatatcaaaaaaggcagtttaaagcaatgaaatggaatctatttaattggtctgggtataagaacaaatgagaaatatttggtccatatccaatggtttaatctccttaatttttatccagaactaaccccgtatctttggcattttgcagaaataaggattcactttaatatcactatgcaatatttctggatcataatccacctcagggaaggacagatttggttatggagacctcggaagtccaagtctctatgctaaatagacagcagaagaaccaatttaacagctttcaatatttctgtctgactccctgttggaattgcagttttgatgtggtgagtaggcgcatagaattaattggacattcttggaaatattttgtgattcaaatgaagaaataggagaatcctggatgtttcctggggtgttgggcttggggacctggactggggccaatcacattgtgagatgcccctcccagtcctgactttccctccttcttaatcaatatttcaatccttttaagccccaagatgaccaactgagttaaaaggcaggtaggtgagtgagaaaaagagaaaagacagccccactgcttgaccttgtgatgggcctgtagaatgagatcttagaaattcatttgcatatgaaccctaattctgtgtttcctttctcctacaaagcccagttgaccacagccatttttttgtgcctcactggctaacactcagaggatgccttactctagctcccccttactacaaagctccctaaaagtgaacatcacctctggactcactcattgccatggatttctttctcccctaggtttccgcagcctccttttccacttcggatttgaaaacatcttttgtttcgtctttttttccccttgttcaaaaaagaaatggatagagattcttccttgctttctaccttgcctccatttttttttttcttaatccagaattcttgggcctagcataggaaaaagtaatgctccaaatctgcacgtctcatagtggccctaattttatctgggtgctgtgcttgggatgagtctaggcacatcagttatggtgcctatgcctaaatgtcaccacttcaatctcctgtgtcccttgattgtgaaagtaagagcgtgtgtacaaggcactttttgtaagagcctgtgtaggaggcactttttgtattcctagaatctaaaatactggcatgtaaatgttaggaattcacacattgactttaagatctaccctttggttggatgtggtggctcatgcatgtaattccagcactttggaaggctgaggtaggaggactgcttgaggccaggagtttgaaaccagcctgggtaacaaagcgagacctggtctctacaaaaaaataattttaaaaagatctaccctttgtatggccggggggggggcggggggcggggggcggtggatccagcccattggtgtgtagttgataattaaattttgttcataccatagtgttaccggacgagggtgtccaggttcctggcgttttgaacaaagaattggacaaaacacagaaacaaagcaatgaagcaatgaagccacaaaagcagagatgtattgaaaacgaaaagtacactccacagggtgggagcagacccgagcagccactgaagggcccagttacagaatcttcgcgggtccaagtaccccctagaggttttccattggccacttggtgttcaccttatgtaaatgaagtggtggcttgcaatcagtctgattgcagagagcaaccagtcagaggctgagtgaagttacaaagttacactcccatgcaaacgtctgattggttgcaaaaagcaaccaatcagagatacttttaatttcccatctgccaatgcagaaaaatgggggtttgcaaagggagtagccacttgtccttttgtccttttgttacttaggcatggaaagttagggttttcctttcaatttcgttttaggaagtcagcgtgaaatggccttgggttccctgcctccagaccttattattctgcctcagttgcactcagggtccctgtcccatagttctgtgctgatatctgagatatcaagtgtgatattgactgaggcaaacgacaaattaccaattccaaaacgaatactaattgcataataacagtttccaagctgttagtctgctttcctaaaaaagctaatttaacacaagcacagaactggctcttgcccatgggttatattttcggttggcagattttgctttgcaaaaagattgggggaaatgaggactgttgtagaagaagcatacttggccttttgtgaagagggtacaaattgcatcaacctctcaaggcctgaaagtgtgaacacaaggacacttaataccttcaagagaggtcgattacctttcccagaggtaaaatgacctagtgctttggcttgagtgggatccttgaattttcagcccttcgaaggagagttttgtgcaggatggaggtgcttgagtgctgaggaactgaacctgggttggtacgcattgtccataggattcagggcccaggggagggcatggtcactaaatggctgatcctctctggaatgaaactttagaaagcaaaacgcaaaattttttgattactatagaatgctgaagttactggactcctcctgagattatgttcataactttttagctgaaactaacatctacaaagaccatctatcttggatgaacctattttctggtaaccagtgttaaatattttttaatcaaaaatttaaaacttgcattagaataatttctgattttcacctttttaaatagaattttttaaaatatattttttaaagatgaggtctcactacattgccctggctggtctggaacttgtgcactcaagcagtcctcccacctcagcctcccaaagtgctgggattacatgtgtgagccacagtgcccagtttgatttttgcctctgaaatatttgaagtatattttaaaatacatgctttttgtgggattacatttagaagacttctcttttttgaaacttagaaagagtggaaattattatccgcagcagtgtttttgaatattacctttgcctcatgccttaattcttgtggaacctggaagaagtagagatgcattaaaaatagtatatgtatcaaccaggcgccgtggctcattcctgtaatcccagcagtttgggacgccgaagtgggtggatcgcttgagcccaggaagtcgagaccagcttgggcaacatggtgaaaccccatctccactgaaaatacaaaaatcagccaggcatggtaacgcatgcctgtgatcccagctacttgggaggctgaggtgggaggatcccttgaacctgggaggtgcaggttgcagtgagctgagatcacgccactgcactccagccagggtgactgagtgagaacaggtctcaaaaaaaaaaaaaaaaaaagtatatatatgtgtctcttgaagaccccgtcagttatgggaaagggtattcactattctttcccagacagcctgagcatgaaaaaaaaaagttctgttagtgtgtgtcaaattgaatgttggtgttaattgcaggatttgtggggagtagttgtccagctttcaatctcaatatggcaaagccatgtgctcaactgtgaacacaggttagaagaggtcagaactcagtctgatggtgtcctgtggcttttatctttatagatcctgtagttctgttttgagggtacttataacattgaggaagctgatgtttaaaaagaacaggtgccaacattgggaaataagaaatgttggtttcaaaattttctggtgaggatggcagtgggcatgcgcaggtgcattcctagatgttccccactcccgccaggcgctgggggctctgggtagcaataacctcctctctgtgcagaagtcccacattacatgcaactgctttgttgacatttcgtatccacaactgtgaaggtcgcagagtgagatagtgggcaacacagcaaaaaaaatgcatgctttcctaagaaaacagagcctcactttacactgggaacacacaggtgctgtgaaactggactttgatttttcccgtgagaggaaattctgatggaactatggcact[132 bp omitted]cacctcctgggttcacgccattctcctgcctcagcctcctgagtaactgggactacaggtgcccgccaacacg[170 bp omitted]atgaaaagccttgcatttctagagattgctcaaaagcaaaggctgtattgagaagaacttaatgctttttaaaaagtgggcctggcctccttcagctctcccatttttctttttcttgttttctattctggcagttgcacgggaagaagacagcatgaacaatttactgcctgttccagtgaatgatgagtctggatcactgttcaggggactgtctctttgctttgagtcccaataaccccaaatattccctttctatttttaattagcaggaattcaagatctcttaaggatgaagagagcaacaaaatacattggaagttgtgattgtcagttttgagttggggaaggtgtaataatatgccttctgggctggggatgggggagaaaagggagaacagcctcattctggctttggtggagtttcctctcatgattcttctgaagcagcaggacctttgggccggaatggctcctattctcctgtgtcccccacaaaaagggagggcagtggacagaatttggagcatgtcgaatcaatgcttagctgttgccttcgcataaatactgagtagccacttaggaagcttcccctagagtccggagttgggcatgaatgttcctattagcacggatggggctctactctgtctgaaaacacagttctctcactaggaactcacccaccccatcatgcatatgtatgtggtcccaaagggtaagaatgaggatggggtgatggagagcagaggagaaaaagtatgggtcagtaaacacacaacgggtacctggagaacttctgtgaagtgcagggcctattcatgctgacgcagaaaggtcacctcatgaaaagaggactcctcaccattctgtttcaatgtcattcccttataaataccaatccatacattattaaccccatttgatacacacacagacacacacaaatggggcactgactttgtttatttggcatttggtgaactgctcttgatgttgtgctccgcacaattaaaatctgccagaaaaacactttggaaactgtcatgaagatagtaccttagagaagggggactacaaaatgacggctgatgacgggggctcattccaggccaactggggccaggccaaaggaaggcaagggcagacgaggcataggtggcatcggcagcctgagcagtggtggctccagaagagcccatctccaacagggctctggaacacggatgacatgatagggcccatccaagattatgcctacccagtggctcagggcgacagggccactgtcatgttatttctgaacattaattaatgtctcctgatatctcctctacttgactcacctatttttatttttgttttattttatttttttgatatatttaattttgttaactaaatcttaagtttaaatattgacaatgtcacacttgaattattgaatatatttaactttatgaaatatgttgctctaaatatgcatatttagtttaatgtgtattgttttatgtagataacttagagataattttgtatttgtcagtaatcctaaccacagaatgttacagttttcagtggcactaacactttcttctctaagaacattaaaataaatgagccaactggaataatgccaacacttctaattattgggccttaggagtaaatagatcaattgagaactatgtcttctaaaatagcaagcttagagatgtgctcggatgtgacaggtgcttgttcctgatgacaagggtgaatggccttgtaggactctttaaggagattgcacgttagcctaggttttgtaatagccagtctccaagatggtcctcagtgatccttgcctgttggtattcatgcccttgtgtagtttcctcccatattgaattagggttggccctctgtgaccaatagaatacagcagaagtgatggtgggccttccaacgctgtcatgaaatccactgatgcttctgctttggtgtcttggatcactcactctgggaaaagccagctacaatcctatgaggatcctgaataaccactgtaggaaggcccatatggagaagaaggaaggtgtgcaagcaacagccagcaccactttgccagtcacgtgaattagtcagcttggaagtgaatccttcagccccactcaagccttgagatgactgcagccctggccaaaatctgattgcatccttctcagagcaagaacttccaggccaaattcttccaaatttcctgacccatagaaaccatgagaaataataaatgattattgtttttctaacccactaagttttagaataacatgttactgatacagaaggtatggaagtgatgtgactcattcaaggaatttttgttttgttttgttttcgggttttttattttttattttattcatttatttattttttttgacagggtctcactcctgtcatccaggctgtagtgcagtggtgcaactatggctcactgcaaccttgactccctgggcccaggtaattctgctacttctgcctctcaggtagctgggaccacaggtgcacacaaccaccattggctaattttaaaattttttgtagagatggagtcttgctatgttgccagggctggtcttgacctcctgggctccagtgagcctcctgccatggcctcccaaagtgctgggattacagacatgagacactgcagcca[131 bp omitted]gcatggtaaaacgctgtttctactgaaaacacaaaaattagctaggcgtggtggtttgtacctatagtctcagctactcaggaggccaaggcaggagaatcgcttgaacccaggaggcagaggttgcagtgagccaagatcgaaccactgcactccagcctgagcgacagagcaagactcccgtctcaaaaaaaaagtatatatatatatatacacttatatatatatacttttatatatatacacatatatatatacttttatatatatacacttatatatatacttttatatatatacttatatatatacttttatatatacttatatatacttttatatgtatatacttatacttttatatgtatatttatacttttatatatatttatatatacttttatatatacttatatatgtattgtatacttttatatatatatttttaaagacatcagcaacattgtctgattttacttatttatttgttattatatattttttcatacagagacaggatcttgctgtgttgcccaggctgatcttgatcctggcctaaagttatcctcctgccttggcctcccaaagtgctagggcctcccaaagtgctagggcctcctgctaggcctcccaaagtgctagtggcagtgtgagccacttcccagctcataatctgattctaaagagacaaatgatttactaaaccgaaatttattttttaatttaatttattttattttttaattatactttaagttctagggtacatgtgcacaatgtgcaggtttgttacatatgtgtacatgtgccatgttggtgtgctgcacccattaactcgtcatttaccttaggtatatctcctaatgctatccctctcccctcccccaaccccacgacaggtcccggtgtgtgatgttccccaccctgtgtccaagtgttctcattgttcaattcccacctatgagtgagaacatgtggtgtttggttttctgtccttgtgatagtttgctcagaataatggtttctagcttcatccatgtccctacaaaggacatgaactcatccttttttatggctgcatagtattccatggtgtatatgtgccacattttctaaatccagtctatcattgatggacatttgggttggttccaagtctttgctattgtgaatagtgacgcaataaacatacgtgtgcatgtgtctttatagcagcatgatttataaccctttgggtatatacccagtaatgggatggctgggtcaaatggtatttctagttctagatccctgaggaatcgccatactgacttccacaatggttgaactagtttacagtcccaccaacagtgtaaaagtgttcctatttctccacatcctctccagcatctgctgtttcctgactttttaatgatcaccattctaactggtgtgagatggtatctcattgtggttttgatttgcatttctctgatggccagtgatgatgagcattttttcatgtgtctgttgagtgcataaatgtcttcttttgagaagtgtctgttcatatccttctcccactttttgatggggttgtttgattttttcttgtaaatttgtttaagttctttgtagattctggatatcagccctttgtcagatgggtagattgtaaaaattttctcccattctgtaggttgcctgttcactctgatggtagtttcttttgctgtgcagaagctctttagtttaattagatcttatttgtcaattttggctttggttgccattgcttttggtgttttagtcatgaagtccttgcccatgcctatgtcctgaatggtattgcctaggttttcttctagggtttttatggttttaggtctaacatttaagtctttaatccatcttgaatgaatttttctataaggtgtaaggaagggatccagtttcagctttctacatatggctagccagttttcccagcaccatttattaaatagggaatcctttccccgtttctttttttgtcaggtttgtcaaagatcagatggttgtagatgtgtggtattatttctgatggctctgttctgttccattggtctatatctctgttttggtaccagtaccatgctgttttggttactgtagccttgtggtatagcttgaagtcaggtaacgtgatgcctccagctttgttcttttggcttaggattgtcttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtgtcctcttttattttgttgagcagtggtttacagttctccttgaagagttgacccacctatttttaaagcaaaccttcagtcagaggttttataaggtattggtttagtatatcgaacaattaatatcataagaaaaaaaaccccacaacatgtaactctatgccattgacattttaaactacactgggagaagctatttccttattggaaaaatattttaggaaagttaatgctgtatccctttcccttcagttctgttttggactatgcttattgctttgtctttctcctcccattgttaatattctttaagggtttttacccagctcctggatgtaagtctagtggacacattgcaatcagtacctgctgttaacgctatgcttggtaacaagatgaagaaatttcagtatcctgacagtggaccattggggtgtccttgagcagctgcctctggtgcctcacttcatagtgtcaccctggttgtggggatagttgagcgaggtataaggtgggccccatttgcagttatatggaggggaatggtccctccatttgggaagctaattttctcacattgttctcacaataacttcttattgcttattggaaaaatgagttaatactagagatacctactgataacttggtaactacttaaatgcaggcataaagcaatcatggcttgaagccagatactgcaaaaccaatcttttctcacatctgaattcctgtatattaattaatgagtttgcccaataggtaattagtcacaccttgttaactagatataactagatatactgatttaatttagaattttaattaacccacccttctcacatttaaatatttatatcttttgtaatatggaagtagtgctataaacagagttatctatgtaagatgtatgtaaagataactagatattactagaactagactgagtatgtgaagtcaggatgctgtcaaacaagttttcctcaaatttaacttcataattcttattttagaaaacttgctataatatagataatatgtggttcctagttaagtacttacttagagatattggaaataactagaaaaatacctgaatctaggatgttgaaaaacacattctttttacatccgaatttaatttcttttaacataaggtattggaaatatagataactagtggtagctatgtaattttaaattagagatacctagaattagctagaaagctacttaaagccataaagctgaaaaatacatgcttttcatctctaaaatattccttttttaatatttctttttggaatgtgcatttagtactcaaaatacctagcatactaaggtaagctttattttcatttttttgagacaggttctcactctgttacccaggctggagtgaaatggcaccatcatgattcactgtaacatcaaactccctggctcaagtgatccttctgcttcaggctcccaaggagctaggactacaggcatatgccaccatgcctggctaatttattttttattttttattttttatttttttaggtagagatgaggtctcactacgtttctcaggctgatctggaactcctggtctcaagccatcctcccaccttggcctcccaaagcacttgggttgacaggtatgagccactgcacccagcctctaaggtaagctttatataaagataactagatataacctagcctgggcaacatagggagaagctatttctaccaaagatttaaaaattagccacgtgtggtggtgtgagcctgtagtcccagctactcaggaggctgaggcgggacggtcaatagagcctgggaattagaggctgcagtgagcttgatgggctcagtgtactccagcctgggcgaccaagtgaggccatctcaaaggtaaataaataataaaaaatagatacaacctgaatgactagttgaaggcagaaagctaaataacacattttttttaatctaacttctcatcattgaaggaatatgttagtaatatagatgactaatgttacttatataactacttatagagaaataactggaaataactagaaaattaattgaagccaggatgttggaaaacatttttctcaagtgcaacttattatttcttcttgaagtaaagtactggaaaggtagataactagtgatacacagatatatcgaaataactggaaaactactagctgtccaaaaaagaacaacaacaacaaaaaactatacttatctgttctatattttttgaatgctattactataaataagtagtaatcaagaggcatttggtttactctggataactaaacatgagtggaataagtagttaaagctggagagctaaaaaacacaacacaaaattgtcaattgtaaattctccttatcattggaataattagttaatactgtaaatgttcagttggtacctttgtaattatttacctagaaataaccagaaatagccagaatagctagttgaaggcaggaagttgccagtcacgttcttttcaacactaaattctctgctgaagaaaagttgatcaatccaggaagttgaaacaatattcttctcaacactatagtcgtatctattgtggatataatgagttagtgctgtagataactatttgtacccaggacactaactacttggatataactattaatatggaaatgaagatgaggtaggaggccagagaagttattttccagtcacagggtcacgaccccactgatggaaacaggatcaggtcaaaacaggatgcagccgtcccagcctgttggctcgagcctgtaattcctgcactttgggaggccgaggtgggcggatcacttgaggccaggagttagagaccagcctggccaacatggtgaaaacccatctatactgaaaatataaaaattagctgggcgtggtgacgggtgcctgtaatcccagctacttgggaggctgaggcagaagaatagcttgaacccgggaggtggaggttgcagtgagccgagatcgcgccattgcactccagcctggggacacagtgagactcccttaaaaaaaaaaaagaaaaagaaaaacaacaacaaaaacccaaaaaaccaggatgcagggaagaagccagcgaaatccagcagatggcgacaaaagctacctctagttggcttcactgcccattagcatcaagacactcccagtgtaaagataatttacaactgccatagccaggggccatggcaatagccaggaagttaccttgaattttctggatactcctcactcgttttcttgaaagttctcaataacctgcctgttgattagcacataattaaaagtggtataaatacagctgccaacagcccatcagctgctggctctgggtgcactgcctatgggttagtgctgttctgcaagaagcaataccagttcaataaaagttgctctatctcactacctgctcatcctccatccgggcaaaatcccaatttggcagcttgcctgtcctacgtcaaagataaggaggtgagaaaatattctcataaataccttctttcttttctttctttttcttcttttttccttccttctttctcttctttttattttccttcctttttctttccttcttccttcttttctgtcctttctttctttctttcctttcttccctttcttccttcctttccttctttttctttctttttttgagacagcacctcgctgtgttgcctacactggagtgcagtgatgtttgaaagcacagtcttcacagactcaaattcttatttttttgtgaaataatgagtttatactacagatatctggtggtacctatgtcagtagtgaaatagatttaactagaaataaccagaaaaaaaatacgaagtcatgaagttgaaaaaatcatgatttaccactgcaacttcttatttcttattattataatgagttagtattatagatatctggtgatgtctacttcattacttacctcaaaataactggagataattaaaataagtattgtaatcctggaaggtgataaagaaagtcatgcagtactatgttctcgttccttgttggaattttgccttagaactatagctaagtattggtacctgagaaactagatatgtggagacatctgcagataactaaagtatctagtgtaagaagaaaaatattcttcttgattctaaaatgttatttcatgttggcatgatgtgttagtactgcaaataactggtggtacctagggaatgagtaaactggagatcacttgtgatatgtagaataattagtggaatccagagaattacctcatttcttgttggaatgatgggttagtattagaaataactaggtatcccttgtgaaatatacaattagaaataagtagagagaagcagaaaaacttgtagaaacccagaccctggaaacacattttttcaaatctaaattctttttacttgtggaataatgagtgaatggtatggttatgcagtggtacctaggtaattggacacaaccagagtaaacgtttgacagcaggaatgtaacaaagaattaaaaaagattatttatgaaaattaatattattaacataaaaataaattaataatgagcaataccataaaacaagaagtaagtatcacaaacaagaatacaaacattatttggaaatctgacttttatttttttgtaatagagtgttagtattattgataagtagtggtatctatttatttagaggtaacgacttaactcagtcaagtagacacataaaattaaccaccacagtatgtaactagtttagtagggatagttagagataacccggaaatctatttgaattcagaagttgaaaaaccattcgtcacacccctaattcttatctcatataggaatacatatttagtactatggttaactactggtcacaagattactagttaactacagagaactggttggagctagaaggtggaaaccacaatcctcacaactgggaattcttgattagagttccctctaattaactatactactgatacattatttcaaccagaattaagaatttcatgctgagtagattatggttccactttttagcttcagccagttatctgtagttaactagctaagctgttactactaattatccatagtaacaaatccttattcaaacaggagattaagatttagggtggtaatcccagcacttatggaggccaaggcaggtgaattgcttgagcccaggagttcgagaccagcattgggcaaacagtgagacctcgtctctataaaaaaattttttttaattcgccgggcatagtggctcctgcctgtcatcccagctcctcaagagactgaggtaggaggatggcttgagcatggggagtggaggtggcagtgagccgagatgttgccagtacactccagcctgggcaacggagtgagactctgtttcaaaaccaacaagcaaaccaagatttagggtggtatgaaacagtttttcaacttccagattcaagcagattttctggttatttctggctatccctagtaaagtagttacctcgctaccagtatttgtctatagcactaatacatgttgcaaatattaaatttagtgttgagaaaaaatgttttttcattttcctgccttcaaattatcgttctaggtatatctaattatctctaattaaataaataaatagatattattcccagaatcgagccgggtttggctgcgttttcttgtggcccaataaggacaaacagacaaattaggaaagaagggaatttattgctgtaaccggatacagggagaaggtcagagatattccaccagaccaactcaaagcgttaaaattttcttagtgcttacataggttggggttatgtgcctatgtgcagtatagcatttgcctaagtctgtaggtaactaattttgtttcaactaggtcagaggcaaaaaaatgcttgctaagtccgagtatgctgtgaggggcccagtgccttcaaggcatgtctattgtggtactggagtgattatttctgtcttatctcctttataacttggcccggagtactgtcttagactctccaataaatctgtttgaacagctgcctctgttaccttgactcgtctcagatttcatcgacccaagacagatcctggcactaggaatttaaggctgtctgcattattttgacttgctccaggttagggacaagcttatgcaaggctcctactgaccatgtgtttcatttctagctttgatgtctggacaccgatttccctagatttaactatttgctcaatgttaaggcagctctgtggaaatttatgtaactgaagtgttatgcaggcctgtgtgtgattgtcagggagaattggcctgccacaatagcactatgtatcaataatattacctcattgttattttaaaataaatgaaagaattaaaaacaagtctttactaacttcctggtgtcgtatattcattctggttatttctcttcacctttatttaactgattacctatgtaacactagatacctgcactactcactcattattccactatagtaagaaattagctttgacaaaaatgtgttttttcaattttgggctactatgtacttctctatttaactgtacttatgtctaggtactcccagatatctgtagtattaactccttattccaacaagaaattagaaagtagacttgagaaaatgtttctcatcttcctgcattcaaataattattccacttttcacaagctatcagtttgctttttccctagctaccatgacttacatgtagtattaacacattatgccaacaagaaacgtgatgtcagaattgggaagaatgctttttagcttcctggctcatactagtcattctagttacctccagttatccctagatacctacttttttaggtatcactacttttctataattctaaagcaacagtccaccaaagaataaggatctagtatataagactgtgcgtttcaggcaaactaaaatacacaaatgggacttcattaaactaaaaagcttctgcacagcaaaagaaataatcaacggactgaagagacaacctgttgaatgagagaaaatatgtgcaaactgttcatctgacaggggactaatatgcagaatatacagggaactcaaacaactcaagtggaaaaacccacaaataatctcatttaaaggtgggccaaaaacatgaatagacatttctcaaaagaagacatacaaaaggtatacgaaaaactgctcgaattcgttaatcatcagagaaatgcaaatgaaaaccacaatgagatattatcttatgccactcagaatagctattattaaaatgacaataaataacagatgttactgagtatgcagaaaaaaggtaagtcttatacagtgttggtgggcatgtaaactagtatagccactatgaatgacagtgtagtgatttctcaaaaaactaaaaatagaattaccattcgatccagcaatcccaacactgggtctacccaaagggaaagaaatcaatatatcaaagggataccttcattcgcatgtttattgcagcactattcacaatagcaaagatacggaagcaacttgtgctcatcaacagctgaatggataaagaaaatgtggtacatatattccacagtggaatagtattcaaccacaaaaaagaatgaaatcatgccatttgcagcaacatggatggaactgcaggtcattaccttaagggaaataaaccaggcacaaaaacacaagtatcacatgatctcacttatatgtgggagctaaaaaatgtggacacatggaggtagagagtggaaaaatagataacatagaatggaaagagtggagggaggggggatgatgaagagaagtcggtggaagggtgcaaacatacggtaagatacaaggaataaattcaatgtctgatagcagagtagggtgaatatacttaacaaaaatatacttgggtgagggataccctaataccctgacttgacactatgcattaaatacatgcaaccaaatttattctgtatcccctaaactggtacaagtacacatgtctcacgcctgtaatccaaggtactcaggaggctgaggcaggaggattggttgggtccaggagttcaagaccaacttgggcaacactgtctctagaaaagaaaaaaaaaaaactgtgcatttcaattttgaccacaaacgcatgttccaactatctttagttacctctagtaacctcgttgaataagtatcaccagctatccatagtattagctgattatgataacaagaaaccagaggttagagtggtaaatcatgatttttcagatttgtgccttcaaatattttttctttttttttttttttgagacggagtctcgctgtgtggcccaggctggagtgcagtggcacgatctgggctcactgcaagctcagcctcgcgggttcacgccattctcctgcctcagcctaccgagtagctgggactacaggtgcccgccaccacgcccggctaattttttgtatttttttttagtagagacggg[131 bp omitted]ttctacttaattcaaatttactagcgacctacataccaccagatatctgtagtacaaactcattttatcaaggaaagataagaatttcgtcttgtcgaggattgctttccaggttccaggcttctctgaggttttctagttatttctagttatctccagttcagtagttaccatgtactcctgcttatatagaactaactcattatgctaacaagaaataagaagttggttataggaagacgttgttctccactctctggctttatctgttattgacattttacaggtgtgacattattgagtcacagagacgttaagtaacctggtcaaagtcacccacttgggaaatgtccagcgctgggatttgaacctatcttgagtactatccgtgatacagaggatgtttgttatcatgctatatgctataattttcttttgtaattagtagctgtaattatcgctatttaactagtttcctgtgttcaagcagttatctctaggactaactgattccaacaacagacaaaaatgtagtgttgaggagaatggttaacttcctgaattcaaccacttttcttcagcatcctggtttaaacttcttattctagataatctcatttatccctcggttactaatgagggaggtaccactagatatctatggcactaattcgatattcaaacaagtgaaggaaattttgagctgaatgatactttatttctgtttatctctagttaactaattacaaaagaataataattatagcataatagcaaacgttattgagcacatcctctgtgtcagggatggtactgaggatgggttcaaatctcagctttggacattttccaagtgagtgactttaagcggggtacttaacatccaggtgactcaataacactacctataaaatgacaataatagcacatcaatatgtaccagtttgttaagaggattacatgtgttcatataaacaaatcacttagatcattgcctagaacacagtaagaaccaggtaagtgtgagctaccattagtatcatctcaattaatctccacaacagctccatgaggtaggtattattataacaggttttacagatgagaaaaatgaagcacagggagaaaaaaccactccccaggttagctaggtagcaaatgtcaagcaaagccatgatgcagatgccagcagtctaactccagggtccctgccctcataaatctaggacatcaaactcatcatttgggcctatttttgcttggatgatgctcaattacgtacaaaacatttgcaagaagtgactcaatttaactaaaaattttaagtgaatactaattgattggtggcccggtaggtaacactcaccgaaggggcacagaaatgactactgaagcttagaaagcactgaagcaagtcatggaaatctctcagacaccacacaactccaattctgacagatgtcctagctgggctaaggcacaccatgattaaaatcattgtaggtctctcacatagtaactgatcccaggccaaatttcatctcagagtgtctggccacgagaagggtgaggtctacagaaccctgcaagcggcagcctgaggaggagacgtcttggttaatgtcagggagagtctgtgggggtgaaattccttgacagcattttcagagtgaattgttcaaccaaccatcttgtagctggtttcctctctatcctcctggaacaggagaaaggagagacttacctgtctagcacagtgggcgaagtgagtgggtgtacctttatgggcctatgaaaatggtttattttattaaatgggtctgatggcaatggtgtttatcatggcaaaaaaaaaaaaaaggataaataatcccaatattcaggaaaccaactcattccaaggaacaattcttatttttaattaattaattaattaattaatttttatttatttatttttttagagccagggtttcattgagtcacccacgctggagtgcagtggtgtgatcatagctcactgcagcctccaatgcctggggttaagcgatccccccacctcagcctcctgaatagcttgcacgacagcgcatgacaccatgcccaactattttgttttttatttttttagagatgggtttttttctattttgctcaggttggtctcaaactcctggtctcaagcgattctcccgccgaagccacaggaggagctagtatttacaggcgcgcacaaccgagccc[135 bp omitted]tcctgaggcacacttcttaagggaaaaacatagaggtcccaatcggccctggctcttttttatttgacatttatcagtagggagcaaaaggtcagaatgatagttctagacaaagagtaggaaatgagaagcaggaggaggaggatgggtaacagaagtgggtgaggatggagggaagacgggagctaacccaagtccccagcgcctgcccagcacagtgaacactggcacttctgcagagggcttgcaacctaaggcgccagagcccagcatagcttagcagacattgcatgctccacagtcgcgtctagcgccaaaggaagggccacttgcagtgtaagccttctgggatgcactaaacaccaggcagggttctatgtgtactctgacgtggagtacctggagcttttgcaaggggcgtgttaggtttcttgcaacttgcacctgagcatccagagtgctctgcaaatcccagccccaaacttctgcttccacagatctcctggagagcgtggcgcactcaactttctggacattgctgcaaaaacctagcatgcagcctctgacttcatcatttcatcttaattacggtccgattcgcggactttgggtgggaacagaccagagctagagagactcatccattagttactaactacccagaggggagagcagtgctggcagtccaaattgcaaggtgcgctgccttcagcgtgcggcgtcttcgccctggagaagcattacgctggcccgcctgcctccagggccacacggaaacgtgttctgcaaactttctccaagggctcgggggctagattgtgtctcgctccgctgcctctccccctgcctcaatttcgactcctgccagacagctcagcccctccctctggcagtcaccccgcccggagtgggagtggtcaacgaagctgcaaaatggatcgcaagtccccacacacgtccgacccctccccgcgccctgaccacgaacgcatccctgacttaaccgccacactcgggccgtgagcgcctgccagcagggccttccgccacacacacacacacacacaccgcaagcagcggcgaccagggcaggagcccactccccgccacctgcaggcgtcggacccgaagtccacgagccggaactcagagcaggagccgaaggaccccagcgcagaatccgtggaggcgcacggcttcatccaccgcgctcccagatggggtcccagcccagatccggccacgaagacacaggcaaccccggcctgggtttcctgttccatgagctccaggaaggcgacagtcagtgcttgtctggggacccggaccggtgctttggggaactcccccggagggagagagtttggggaactctcccgagaagggaactttcccggagaggggggcgtggaccggacgctgctgcgcctcctctctcaggccgcggttctatgctgccctgtgcccgcgccaaacgccctgatctctctctgtctcctctctcaatctctctttgcctttcctcctttccagatgcgaaggctgtagggactttggtgactgaagctggaggagacgaggagaagaaaatacggtccaaacccgagcagggagctggagcagaagaagaaagtcacttctgtgcgggagctgccgaccccacgatcaaggataaccagaagcgcggcggtggcgaccaggagccctcgcagcagcagcctgaggcttccagcccaggactcctccgcggaggagccacaaccccaatattagcggcgtctcttcagccccagtgcgttcagcaggttgcacctgaaggagctagacagcattttcccacgctctgaatatctcgacgtgttcgctcggtaagcggcttgctctggagcttcccagttcccaggactctggggctcttccctggacgcctttggctctacccatgtctctttaccaggctccagtgccaagagctatttagggggctcaaggccactggctcagggccgctcttgagctgtgggatgcgggcgatagcaactgggcatcaaggtatttttcaagcagtatagatacgaatcaagttaaatatttgcattaaaattattaatcttcgggctggtgctgtggctcatgcctgtaatccgagcgctctgggagggcaagtcaggaggatcacttgagtccaggcgttcagggccaggctgaccaatatactgagacttcatctctacaaaaaattttgtaaaattagctgggcatattagcagcacgcacccgtaatccaaggtgctctggaggatcgcttgagcccagagttcaaggcttcagtgaactgtgatccggccactgccttccagcctgtgctacagagctagaccctgtctctaaaattagatacatagataaattacatgaatagatgacagatagatagagatagaaaaatcttgaatcctaagtgttttagccctctctgaaattctgcacacaaaggaaaacaatcccctacctaatgcaagcctggggctatttttaggtatcacagaaaaatgtgcaggagcagttgggaggctagacattttcaaactggtatgaaatgttcataggtgtatttcgtttcatccacaattccaaatactgaatttttgtagttttctttcccagaaagcagcttgcaatctgcatggatgtgagtgaagccgaagtggaagccagtaagcctgatgaaagcaattggtcagagtagccactctctgaaacctgcctcagtccttgaatacctttgtcctacacattctccaattggcctgtttttgttgccttttctatgtttgccaagtgagttttgaactttagcgggggaataatgggatacataaaccttagcctatggaaatttcccattaccagagggaatatgctttctaatgcgaaacagaactaaactgttacttctatttcctgtacaaggttaagtgtaaataaagttccattccttctaacaatggtatcctttagagaacacttctgtgtggagttatgttgggactgagtctgacttgaggagtttgcaaattaatgcaccaaggacccatattgtgagaaggttcaactgtatttaaaatatttaaaccaggctatgttcttagctaaatgaccaaatttataaatattcaggcattgggataagggaataagttacatacagaaagaacacattatatgagtaattaatgtatgtttagtttcactgagacttatggggaggacatagcttaaaagtccaagtgcctggtagtcctgctgttgtttttaagggtctgatgaagccatgtagaaagtggcagcccgcaattttgattttctccaatacttttatttgtaagccggaatacactgctaatatacttgcattacactgggggtgtgggggggcaggtttgcaaacaggaaatttgtttaaaaattggaataaaaaagaacaattttgaaaaagttttcacttaactaagaagggtgaaaaggttaaagaaaaattgcatacactcaaatatataccttgaaggtatggcacaaatggagctctatgagggaatattctctttaggaatttctgacaactaagaagttttttttatgttactgttttaaactggtgggttttatgtaatttgtttggtggtggggtggggcacgctcaatttagaccaggttcttacctgtgctaatttgaaatggtttttcattttcccaggcagtggtgattaatttgtaagtcatgagatcaagaaattactaagattacttcagtattattgactgagtatattttcaaaacaaagagaaaatccaggattaggttatgagcagtgctgtgcagttcatgtgagtgcagtgatgggccccccatgactaagccttttttttcagaccatctttttcactctcaagagttttcagaggatgaagtctggcccagtggctcacgcctgtaatcccagcaatttgggaggccaaggcaggcagatcacgcgaggtcaggagttcgagaccagcctggccaacatggtgaaaccccatggtgaaaatacaaaaattacctggacttggtagcgcaccactgtagtcccacctactaggtgtagcatgaggcaggtggatcgcttgaacctgacaggcagaggttgcagt[132 bp omitted]gatccagcctgctcctattgatgtagttacttcagactgaagatgggcttttcaaacggggttgcagtgtgtaaagatccggccattgcactccagcctgggtgacagagtgagactccgtctcaaaaaccacaacaaaaaagaaactttagaaagcaaaacccccaatttttttgattactatagaatgcagaagctcctggactcttcccgagattgtgttcataacttttcagctgaaactaacatctgtgaagaccatctatcttgggtgaacctattttctggtaaccagtgttaaatattttttaataaataaaaattttaaacttgtattagaacagttaatttctcgtctttgccttttttccttttttaatatgtttttaaaatcccttttgagagatgagatctgaatatgttgcccagactggttttgaactcctgagctcaaacaatcctctcacctcggtttccagaagtgccgggattacaggcctgggcgatcacacctggcctggttgttgcctttgcaatatttgaagtacattttaaaatacatgcgttttgtgggattacttttaaaagaactctctgttttgaaatttagattgagtggaaactattatctaaagcattattttttactatttcctctgccccacgccttagttcttctggaactttgaagaactagagagacattaaaaatagtacatatgtcggtgagttgccgtggctccgttcaagcgatgccggggggtggattgcatgagcccaggagtttgagacaagcctgggcaacatggtgaaaccacagctccactaaaagtacaaaaatcagctgggcatggtggtgcatgcctgtagtcccagctacaggggaggctgaggtgggaggatcccttgagcctaggaagtggaagttgcagtgaggtgagaccgggccactgcactccagcctggacgacggagtgagaccctgagtcaaaaacaaaaacaaaacagacaaacaagtaaatacatgtctcttgaagactccatcacttatgggaaatggtattcactattcttttcctgagcatgaaaaaaatgttctgttagtgtgtgtcaaattgaatgttagtgtttactgcatgatttgtgtggagtatttctttggcttccaattgcaatatggcaaaaccatgtgctcaactgggacaaaggctagaagaggtcagaactcggtctgatggtgtcctgtggcttttatttctatagattctgtagttctgtttagagggtacctacagcattgaggaagctgatgtttaaaaa[185 bp omitted]ggtggcgggcgcctgtagtcccagttacacgggaggctgaggcaggagaatggtgtgaacccgggaggcggagcctgcagtgagcccagatcgcaccactgcactcccgcctgggtgacagagtgagactccgactcaaaaaaaaaaaaaaaggaaatgttggtttcaaaattatctggtgaggatggcagtgggcatacacaggcgcattcctagatgttccccaattcagccaggcgctgggggctctgggtatcaataatctcctctctgtgcagaagtcccacattacatgcaactgctttgctgacatttcatatccacaactgtgaagttcgcagagtgagatagtggacaacatagcaaaaaatgcatgctttcctaagaaaacagagcctcgctttacactgggaacacatacgtgctgtgaaactggactttgatttaacccctgcgagaggaaattctgatggaactgtggcacttatcttagtaatcacttcatagtgcagccttggtgctcacaattaaccacttttaatagccaacgagaagtcttgcattgctagagattgctcataagcaaaggctgtattgagaagaacttaatgtttctttaaaaatgggcctggcttccttcaccctcccatttttgtttttgttgttttctactctggtagttgcacaggaagaagacaccatgatcaaatgactgcctattccagtgaatgatgagtctagattactgctcaggggaccatctccttgattccagtgccaataaccccaaagatgccctttctatttttaattagcaggaattcgagatctcttaaggatgaagagagcaacaaaatacattggacagtgtgattgtccgttttgaattggggaaggtgcaataatatgccttctgggctggggatgggggagaaaagggagaacagcttcattctggctttggtggagtctcatctcatgattcttctgaagcagcaggacctttgggccagaatgactcctattcccctgtgtcccccacaaaaagggagggcggtggacagaatttggagcatgtcgaatcaatgcttagctgttgccttcccataaatactgagtagccgcttaggaagcttcccctagagtccggagttgggcatggatgtccctattaacattgatgggtccctattctgtctgaaaaaaagggccaaactagttctaaattcactaaaagtcacccgcaccagctctgcagctcctttccatcactgccctcacacaaactgcagagcgaggctcataacctcatcctggattttgttttcgttttggaaaattctctcttaataaaacttaagtaatcttagaaatcttttgatcccatgacctacaaattaatcatcactgcctgggaaaatgaaaacgtatttcaaataagcacaggtaagaatctggtttaaattgagcgtgctccccatcaccaaacaaatttcataaaacccacctctttagacagtcccatcaaaataattccttagttgttagaaattcctcaagagaatattcactcataaagttcaatttgtgccatttcttcaaggtatatatgtaagtgtatgccattcttctttaaccttttcacccttcttaggtgactggaaccttattcaaaattgttcttgtttgttccaatttttaggcaaatttccagtttgcaaacctgtctccccccgccccccactgtaatgtgcgtatattagcagtgttttcaggctgacacatcgaagtattccagaaaattacaatttcaggtagccactttctacatgtcttcatcagacacttcgaaaaaatagcaggaccaccaggcacttggacttttaagctatctcctccccatcagtctcagtgaaactaaacgtacttaattactcatatagtgtgttgtctgtgtgtgtgacttagtcccttaacccaatgcccgaatatttataaactcactcactgagctaagaacctaacttggtttaaatattttaaatacagttgaagcttctcacatcgtagctctttggtgcattaatttgcatacttctaagtcagactcagtcccaagatacctccacacagaagtagtctctaaaggatactattgttagaaggaaccgaactttgtttattcttaattttgtacaggaaatagaagtagcagtttggtatgtatagttttatttttccattagaaagcatattccctctggtaatgtgtaatttccataagctggggtttccttatcccatttttcaccctctaaagttcagaactcactttgcaaacatagaaaaggcaacaaaaataggccaacttgagaatgtgtaggacaaaggtatcaaaggactgaagcaggtttcagagtggctactctgaccagttgctttcatcaggcttactggcttccacttcgacttcacttacatccatgcatattgtaagctcctttctggggcagaaaaccacaaacgttcagtatttaaactttttcagaattgtggatgaaatgaaatacactgatgaacgtttcataccggtttgaaaatgtctatcctctcaaccgctccagcatatttttctgtgatacctagccccaggcttgcattagggatggctgtccttggtgtgcagaatttaaaagagcactaaaacactcaggattcaagatatctctttctatttaactgtccatctatctatttaattttagagatagggtctagctctgttgaccaggctggaggaggggtgacacaatcatggttcactgaacccacgaacacctgggctcaagcgatcctacggagtagctgagactacaggtgtgtgccaccatgccggtctaat[132 bp omitted]cctcagcctcccgagcggctgggactacaggcgcccgccaccacgcccggctaattttttaaaatatttttagtagagacggg[136 bp omitted]gtatcattatattgctcaggctggtcttgaacgcctggactcaaatgatcctcccgccttggcctcccagagtgctaggattacaggcatgagccaccgaaccagcccgaagattaacaaatgttaaggcattattttaaaaatcaagaccaatgaaaaaaatccacagtaaccaaattgttaaaatgttcaataaaggcaagatccaaccgtgtaggactcactctcctcaccctgatgtccatcgcaattccaacaaaacatttccaaaacaggagtctggccaaagtttcctggcttgattcgtttctataatgcgtgaaaaaataccttaatgcccagtaggcatcgcccccaccccacagctcaagagtgacctactccagtggccttgagccccatatgtagcttttgactctggaggggagggagcgagactggggcagggccaaaggcgtcccgggaagagccctagcgtcctggataattgcgcacctctagagcaagccgcttacctagcaaacacgtcgggatactgagagcatcggaaaatgctgtctagctccttcaggtgcaacccactgaatgcactgggggagaagagatgctgctgatcttctggctgcagctccgaggaagaagagtcctgggcggactcctcaggctgctgctgccagggctcctggtatccaccgccgcccttctggttctcgtcgaacatggggtccgcagctcccgcgcagacgtgactttcttctgcttctgctccctgctcgggttcggactcttcttcttatcctctcctcccacttcaatcaccgaaggccctatagccctatagccttcgcatctggaaaggaggagagggaaaggaagggagggagggagggagggagggagagagagagagagagagagagagagagagagagagagagagagagagagaggcgcacagggcagcctagactcgcggcctgagaaaggtggcacagcagcttcccgcccacgcgcctctctccgggaaagttcctttcctagagttgaacaaatcaccggtccgggtccccagccaggcactgaccgtcgccttcctggagctcatggaacacgaagcccaggcagaggtagccggtgtcttcgtggctagatctgggctgggacgcgatctgagagcgcggtggatgaagccctgcgcctccgcggattctgcgctggggtcctctagctcctggttcgagttccggcgcgtggacttcgggtccaacgcctgcacgtggcggggagccggctgctgccctggtcgcctccgctggcggggtatgtgtgtgtgtgtgtgtgtgtgtgtgtgtgtgtgtgtgtgtggcggacggaaggtcctgctggcacgcgctcacggcaggaaggtggcggtaaagtcaggggcgagctcctggtcagggcgcggggagggggtcgggcgtgcagggaacccgcgctccagtttgcggcttggttgaccactcccaacccgggtggggtgactgccaggaggaaggggccaagctgcctggcgccaacagattggggcaggggaaggggcggaggagctagacccaatagagaaagttaacagaacatgtctctgtccagccctccaggcacgcgggcttgcagaatgcttctccagggcgaaggcgctgcaagctgaaggcagtgcaccttgcggcgtgggttcctggcaccacgctgccctctgactagttggtgactaatgcatgagactctctggttgtgttccgttcgcactcaaagtcctcgaatcggaccgtaattaagatgaaatgatgaggtcggaggctgcatgctaggtttttgcagcaacgtccagaaaattgagcacgcaacgctctccaagggggtctggggaaccctgagtttgggcctgggtttggcagaccgctccggatgctcaaatgcaagctgcaagaaacctaacacgccccttgctaactaattactccacctcagagtacaagcgtagaaccctgttcggtgtttagtgcatctaagaagggttacactgcaagtgaatcttcctttggctctagacgcgactgcggagcatgaaatgtctgctaagctatattctgctccagagcctcaggttgcaggccctctgcagaagcgggagtgtttcgtgtgctgggcgggcgctgtggacttggcttagttcccgccttcccttgctcgtcatcaccttctcttacccaccctcctcgtcctcctcctgctttccctttcctactctttgtctagaattatctttcagacctcttgctccctactgataaatgtcaaataaaaaagaggcagggtagattgggagctctatgtttctcccttcaagaagtgtgcctcagaacgatgaaggctgtgggttacagtgatctatggtcgccccactgcaatcctgccactgcactccagcctgggagaaaaagagagaccctgtaccttaaaaaagaaaatggttcctcgggatgatgctgggcccggtggtgcgtgcctgtaatcctagctactccaggaggctgaggcgggaggatcgctttagcccaggagtttgagaccagcctgagtaacacagcaagacccccatctctcaaaaaataaaaaacaaaaatagcgggacgtggtggcacgcacctgaagtctaagctactcacctagctgaagcgggaaaatcgcttgaacctaagcgttggagactgtagtgagctatttttaccagcggaggctgttcagtttgttggcgttttgaacaaagaattggacaaaactcgcaaggaaacaatgaagcaacaaaagcagagatttatggaaaacgaaagttcactccacagggtgggagcaggcctgagcagccactcaagggccccgatacagaatcttctcgggtccaaataccccctagaagtttcccattggctactaggtgttcaccttaggtaaatgaagtgatgactggcaatcagtctaaatggttgtggaaagcaaccaatcagaggctgaagtgaagtcacaaagttccattcctctgcaaaggtctgattggttccaaaaagcaaccaatcagaggtacttttaatttcccgtctgcccagcagataaggtgggggtttgcaaagggagtagccacaggtgcttttgttacttaggcgtgggaagttagggctttcctttcaatttagttctaggatgtcagcctgaaacggcattaggttcactgcttccagaccctattctcctgcctcactatgatcacaccactgcactccatcctgaactacagactgagaccctagctgtaaaacataaaacaaaataaaaaataagaatcaggccttggaatgagttggtttcctgaatattgggattatttagccaattttggccttcagaaccaccactgtcatcaggcctatttaataaattaaacaattttcataggcccctaaaaagaactgggacccccactcactttgcccactctgcctgacagataaatctctcctctctcccattcctggatggtagataggaagccagctacagaatggttggttgaccaattcactctgaaaaagctgtcaaggaatttcacccacagactgtccctgacattaaccaagacgtctcctcctcaggctggatcttgcagggtccggcagacctcacccttctcatggccagacacactttgatgaattttcgcctgggatcagttactatgtgagagacctacaatggttttaatcatggtgtgtattagcccaactcggatatctgtcagaattggagttgtgtggtgtctcacagctgagatttccatgacttgcttcagtgctttctaaatttcagtagtcatttctgtgtccctttggtgagtgttacctaccagagcaccaatcaaagtagtatttactttaaaatttttagttaaattgattcacttcttgtaaatgctacgtactgaattgagcctcatcccaataagcataggcacaaatgatgggtttgatgtcctagatttatgagggcagggaccctggagccagactgctggcatctgcatgatggcattgcttgacatttgctagctagctcacctgatgagttgccttttctctctgtgcttcaattttctcatctgtaaaatgaggtgataataatatctacctcatggagcagttgtggagattaattgagatgataccaatggtagctcacacttacctggttcttactgtgttctaggcaatgatctaaatgatttgtttatatgaacacatgtaatcctcttaacaaacctatatacacattgatgtgctattatacgtcattttacaggtggtgttattgagtcaccaaggtgttaagtatcctgctcaaattcactcacttgggaaatgtccaaagctgagatttgaacccatcctctgagtattattcctaacagagaggatgtgcccaatgacatttgcaattatggtataattattattcttttgtaattagttaactagaaataagcagaaataaaagtatcattcatctcaaaatttctttcacttgtttgaatatcgaattagtgccatagatatctactggtacctccctcattagtaaccgagggataagtgaggatatctagaataacaagtttaaaccaggatgctgaagaaaagtggctgaactcagaaagttaaccattctcctcaacactgcatttttgtttatcgttggaatcagttagtcctgtagataagtggttgcacacatgaaaatagttaaacaaatcccagctctggacatttccccagtgggtgactttgagcaggttacataacatctgtgtgactcaataacatcacacctgtaacatgtcaataacagataaagccagagagtgaagaacatcttcttcctataaccaacttcttatttcttgttagcataatgagttagttctatataacaaggggcacataggtaactactgaactggagataatgagagataactggaaaacagagaagcctggaacctagaaagcaattttcaacaagacaaaattcttatgtttcattgataaaatcaatttgtactatagacatcaagtggtaggtaggtcaatagcaaatttaagtaaagtagaaataattagaaaataacttgaaggtatgaatctgaaaaatcaggatttaccactctaacttctgatttcttgttataataatgagctaatactatagataactggtgatacgtattgatgtggtttggctctgtgtccccacccaaatctcatcttgaattgtactcccataatacccacatgttgtgggaggtacccggtgggagataatttgaatcatgggggcggtttcccccatactgttctcgtggtagtgaataagtctcatgagatctggtggttttatcaggggattctgcttttgcatcttcctcattttctcttgcggctgccatgtaagaagtgccttttgcctcccaccatgattctgaggcctccccaaacacgtggaactgtaagtccaattaaatctctttttcttcccagtctcaggtatgtcttcacctgcagcatgaaaatggactaatacacctctttaatgaggttacaagaggtaactaaagataattaggacatgcatttgacgtcgaaattgaaatgcacagtcttaaaaaattgtttttctggctgggcatggcaacttatgcctgtaatcccagcactttaggaggccgaggtgggcgggtcacctgaggttaggagtttgagactagcctggccaacatggtgaaaccctgtctctactaaaaatataaaaattagttgggcatggtattgggtgcctgtaatcccagttactcgggaggctgagacaggagaattgctcgaacctgggaggtggaggttgcagtgagccatgattgtgccattgccctccagcctgggcaatggagcgagactctgtctcaaaaacaaacaaaaaaattgtgtttcttttctagagacagggtttcactatgttacccaagctggtcttgaattcctgggcccaagcaatcctcctgcctcagcctcctgagtaacttggattacagatgtgagacatttgtatttgtacaaacttatgggatacatgaggaatttagttgcatgaatttaatgcatagtgtcaagtcagggtattagggtatccatcatccaagtacatttttgttaagtatactcatcctactctgctatcaaacattgaatttattccttctatcttactgtatgtttgcacccttccacccacttctcttcatcatcccccctccctctgctctttctattctatgttatctatttttgccctctctgcttccatgtgtccacatttttaagctcccacatataagtgagaacatgtgatacttctctttttgtgcctggtttacttcccttaaggtaatgacctgcagttccatccatgttgctgcaaatggcattatttcattcttttttatggctgaatattatctcttcctgagaggccttagactgagccaatatttaacgctggctacaagaaaataggttcacccaagatagatggtctttgtagatgttagtttcagctgcaaaattatgaaccagtctcgggaggagtccagtagcttcagcattcaaggccccagatacagaatcttctcaggtccaagtaccccctagaggtttcccactggccacttggtgtccacctcatgtaaatgaagtggtagcctgcaatcattctgattggttgcttgtcacaaccaatcagaggctgaaataaagttacaaggttcacagccaatcagaggtgaatgtgaagttacaaagttgcacttctatgcaaagtaagacttggcccacaatcagtttgattggttgcagacagcaatcaatcagaggctgaggtgaagttacaaagttacactcctacgcaaaggtccaaatggttgcaaaaagtaccagtcacaggtactttcaacttcccattggccctgcagaaaaagtgggttttgcaaagggtgtagcctctggtccttttgttatttaggcatggaaagttagggtttttgtttcaatttagttctaggaagtaagcgtggaacggccttaggttttctgcctccagaccttattttcctgcttcagaagggctgaaaactcaaggatcccacccaagcagaagcactgggtcattttacctttaggaaaattaatcaacctcccttgaaggtattcggtatccttgtgtccacgctttctggccttgagaggttgatgcactttgtaccctcttcacaaatggccaagtatgcttcctctgcaacagccctcatttcccccaatatttttgcaaagccaagtcagccaaccaacagtacaacccgtgagcaaaagccagttctgtgcttgtgttaaattaacgtttttaggaaagcaggctaacagcttggaaactgtcatgatgcaatgcaattggtatttgttttgaaatatgtaacttatggtttgcctcaataaatatcacacttgctccttctcagatatcagcacagaactatgggacagggaccctcacttcagtggtataaacaaaatttaattttcaactacacaccaatgggctggatccccccatacaaagggtagatcttttttttttttttttttgagacggagtctcgctctgtggcccaggctggagtgcagtggcatgatctcggctcactgcaagctccacctcccgggttcacgccattctcctgcctcagcctctctagtagctgggactacaggcgcccgccac[175 bp omitted]agagcatgggtttcgctttgttacccaggctggtctctaactcctggcctcgaacaatactcctacctcagcctcccaaagtgctggaattacaggcatgagccaccacgtccagatgaagggtagatcttaaggtgaatgtgtgaattcctaacatttacatgccagtgttttagattctgggaatacaaaagatacctcgtacacacattcttgattttacaatcaagggacacgagagattgaagtggtgacattcaggcatagacaccataactgatttacctagactcatcccaagcacagcatccagactaaattagagccactatgagaagtgcaggtttggagcgtgactttttcctctgataggcccaagaattttggtttaagaaaaaaaaaaaaaatagaggcagggcagaaggcaaggaagaatctctgtccatttcatttttgaacgaggggcaaaaagatgaaacaaaagatgttttaaaatcagaagtggagaagaaggctgtggaaacctagtggagagaggaatccatgggaatgacagagcccagagctgttgttcacttttagggagctgtgtggtaacggggagctgggagtagggcatccactcagtgttagccagtggggcacaaaaagatggttgtggtcaactgggttttataggagaaaggaaaacagaactcaggttcatatacaaatggatttctaatgtctccttccacagcccccattacaaggtcaagcagtagggcctgtcttttctctttttctctctcacctacctgccttttaactcagttggtcttcttaaggggcttaccaggattgaaacattgattaagaaggagtgaaagtcaggactgggaggggcatctcacaatgtgactggccctggcgcaggtccctaagcctaacaccccaggaaacatccaggattgtcctatttcttcatttgatcagaagatatttccaagaatgtccaattaattctatgcgcctactcaccacatcaaaactgcaattccaacagggagtcagaaaaattttgaaaggtgttaacttggttcttccgctgtttgtttagcatagagacttggacttctgaggtatccataaccaaatctgtccttccccgagatggattatgatccagagatattgcatagtgatatattaagctgaatctttaattcagcaaaccaagatagggggttagttctggataaaaattaagcagattaaaccattgggtatggaccaaatatttctcgtttgttcttttacctggaccaattagatggattcctttttcattgctacaaactgtcatttttgctattcatttattcatccatttattccctgttgtcttagaatagataggcagatacagagaattacagtttaccaggagtagaagcccaccagcagaaacccacagttggagccaatatgagtaggaaaactttcaactgtcattgttgaatttctagaagctcagcatggactatctggagagttaaaactccaagggtggtggcagccttaaggggactgcacattttcatgagttttatctccagaagccccaccaagttgtcactgggaagggagggcatgggaatcccttcctgcttccagcaggtggacaagaaaagcaatcattttgaaatatgcccagagctctttgttttccttaaccaaggactactctgggaagaaactattttatcagagcctaaccaacttgggtttccccagactgaccaaccacggcgaaaggaagtactcaactccagccccgtctagtctgccatctaacccaaaaggatgggtggggacgctgagaagcacttgtaaaggtcacagcccagggacacaggctcagtgaacaactgagatctaatcatggcatgatagaatgcttgccctcctcccaaccttatcaccacatcagtaagaatcctgtataataactgcagattataggtgaattacagctgaaaagactgcaagcctcacattatatgtaagaaggagcctctagaaaaactcaaagacaacaaaggaccctaccaagacaaggacccttcaacaaactttaacttctgacacctaaagttacagccaacagtaaacagcctaatcttcctagccagagaaccataaaacctcacacaaaagtactatctacctgagttttttttttttcctttttcctttttttgtagtgacagggtctcactgtattattgcccaggctggtctcgaattcctggcctcaagtgatcctctgactcagccttccaaagtgctgggattacaggcatgagccaccacacccagcctacctcagttctttctacccagtacatcaggtatgattttcaacaaaaacgtataagactgctaaaagtcaaaaaacacattctgggaccaagtgcagtggcccatacctgtaatcccagcacttcagaggccaaggtgaggggatcacttgagcccagaagttctagatcagcctgggcaacatagagagaccccatctctacaaaaaataagaaaaagtagccagcatggtggcgtgtgcctgtagtcctacttactaggggactggggtgggaggattgcttgagtactgaaggttgaggctgcagtgagccatgattgtgccgctgcactccagcttgggcaacagagtgagaccctatctgaaaaaaaatcacattatgaagagacaaagcaagcatcagaacccaattaaaatacagcagagattttagaatgattagattgggaatttacaataactatgataattatgctaagggctctattggaaaaagtagacaacatgcaaaaacagatgagtaatgtatagaaagataaaaactctaagaaaaaaataaaaaaacaaatgctaggtatcacaaacatagtaatagaaatgaagaatgtcttgaagggctcatcaacagactagagaagacagcaaagaatcagtaaactagaagatatgacaatggaaacttcccaatatgggctggacatggtggctcacacctgtaagtccagcactttagggggccaaaatgggagaattgcttgaggcaagtgtgagaccagcctgggcaacatagcaagacctcatctctgaaaaaaaattatccagacgtggtgcctgaggcaggaggattgcatgagccccagggttggaggcttcagtgagctatgatcatgccactgcactccagcctgggtgacagactgagaccctgtctcaaaaaaataaataaataaataaacgaaagaaagaaaagaggagagatgagaagagatgaaaataaaacttcccaataggacaataaaaattttctaaactgaaaagcaaagagaaaaaaataatgaaacaaaaaccaaacagaatatcaaggaactgtggacaattacaaaggtgtaacctatgcataatgggagaagagagaaaaaattgaaggaataattgatggaataatggcagagaattttccaaagttaatggcagagaccaaaccacagatcccagaaggtcaaagaacatcaaacgggataaataccaagaaatctacatttaaacttactatattcaaactatagaaaatcaaacacaaagagaaactcttgaaaggcggtgaaaacaatggcttacctatcgaagagcaagaagaggtgttcaaagaaaaacaccaacaacctagatttcttcatccggtgaagttaccctttgagaaaaggagaaataaagactttttcagagaaacaaaattgagagaaattgtcaccagtataactgccttgcaataaatgttaaatgtttttcaaagaaaagaaaaatgatagaggtcagaaactctaatttacattggaggccagttcttattggtaaaatattttaggaaacttaatgctgtacccccttgccttccgttctgttttggattatgcttattgctttgtttctctctcctcccatttttaatattctttaagggtttttccagctcctggatatgagtctagtgaacaaactgcactaagtatctgctgttaacgctatgcttggtaataggatgaagaaatgtcagtatcctgacagtggaccattggggtgtctagctgcctctactccctcttcattaggaatagtgtcaccctggtagtggtgatagttgagcaaggtatatggtgggccccatttagagttatagggtgggaaggccccccatttgaaaaggccatcttcagtctgaggtgactacatcaataggagcaggttggatttttaatcaggtttcctcaaggatgtctaaggggtcattcatcctctgaaaactttttttttttttgagacagggtcttgctctgttacccagactggaatgcagtggcacaatctcggctcacctctcgggtccaggcgatcctcctgcctcagcctttgtagtagctggggctacagtggtatcccagcacgtctggctaatttttgtatttttaccatgaggtttcaccatgttggccaggctggtctcaaattcctggccttaagtgatccaccggcctctgcctcccaaagtgttggaattacaggcatgagccactgggcccagacttcatcctctgaaaaatcttgaaactgaaaaggatggtctgaaaaaaaagcttggtcatggggggcccagagagtttgtggcttgtctagctgggacagaatagtcctgatgccctggatattgccttgatattttagcctgcagagttaaggaaaatttggccaaactaggtctaaattcactaaaagtcaccagcactagttctgcagctcctttccatcactgcactcacacaaactgcagagcgaggctcataatctcatcctgggttttcttcttgttttgaaaaaatactcttaataaaacttaagttatcttagtgactttttgatcccatgacctacaaattcatcatcactgcctgggaaaatgaaaaactatttcaaattagcataggttacattcgggtctaaattgagcgtgccctaccccaccaaaaaatttcataaaacctaccagtttaaaacagtaacaggccgggcacggtggctcacacctgtaatcccagcactttgggaggacgaggcgggtggatcatgatgtcaggagatcgagaccatcctggataacacggtgaaaacccatctctactaaaaatacaaaaaattcactaggcgtggtgatgggcgcctgtagtcccagctactcgggaggctgaggcaggagaatggcaggaacccggaaggtggagcttgcagtgagcccagattgcgccactgcactacagcctgggcgacagagcgagactccatctcaaaaacaaaaacaaaaacaaaacaaagcaaaaaaaccagtaataccaaaaactccttagttgttagaaattcctcaagagaatattccctcacaaagctcaatttgtgccgtatcttccaggtatatatttgagtgtatgcaattcttttttaaccttttcagctttctaaggtgagtggaaccttattcaaaatttttcttgtttattccaatttttaggcaaatttctagtttgaaaacctgcccccccacacccccactgtactgcaagtatattagcagagcattcacgcttacaaatcaaagtattccagaaaatttaaattaagtgctgccacgttctgcatggcctcatcagacacttaaaaacaacagcaggaccaccagccaagagtacttttaagttatgtcctccccatcagtctcagtgaaactaaacatacattaattactcatttagtgtcttctctctctgtgtaacttactccctttccccaatgcctgaatatttataaattcagtcatttagctaagaaggtagcctggtttaaatattttaaatacaattgaaacttctcacatcctggctccttggtgcattaatttgcgtagttcttaagtcacactcagtcacaacataactccatacagaagtgttctccaaaggttaccattgttagaaggaattgaactttatcttaattttgtataggaaatagcagtagcagttcagttctgtttaattttatttttccattagaaagcatattccctctgttaatgggaaatttccacaagctaatgtttacatatcctacttttcaccccctaaaattcaaaactcacttcgcaaacataaaaaggcaacacatacaggccaattggagaatgtgtaggacaaagtatccaaggtctgaggcaggtttcagagtggctactctgaccaattgctttcatcaggcttactggcttccacttcagcttcactcacatccatgcatattgccagttgctttctgggaaaaaaaaaccacaaaagttcattatttggaattgtggatgaaatgaaatacacctatgaacatttcataccggtttgaaattatctatcctcgcaaccgctccagcacatttttctgtgatacctagccccaggattgcattaggtaggaatggttgtcctttgtgtgcagacttttttttttttttttttttttggacagagtctggcactgtcaccctggctggagtgcagtggcacaatctcggctcactgcaacttccgcctcccgggttaaagtgattctcctgccacagcctcctgagtagctgggattataggcacccgccaccacgcccagctaatttttttgtatttttagtagagatggggtttcactatattggccaggctggtcttgaactcctgacctcatgatccgcctgcctcggcctccctaagtgtcgggattacaggcatgagccatcatgccccacctgtgtgcagaatttaagagagcactaaaacactcacgattcaagatatctctgtctatgtatctatctatgtgtctatcatctatctaatctatctatgtatctaattttagagatagggtctagctccgtggcacatagtggagggcagtggcatgatcacagttcactgaaacctcgaactcctgggctgaagcgatgcctcagagtagcttggactacaggtgcctgctaatacgcaccactaattttacaaaatattttgtggagatggagtctcactatattgctcaggctggttttgaacgcctggactcaagtgatcctcctgacttggagtcccagagcactgagattacaggcgtgagccacccaccagcccgaagattaataatttttaatgcaaatattttaaaaatcacgaccgatgaaaaaaaatccacaataaccaaattgtcaaaattttcaataaaggcaagatccaatcctgtaggactcactttcctcacgctgatgtcaatcgcgattccaataaaacatttacaaaaacaggagtctagccaaagtttcccagtttgattcgttgatacactgtgtgaaaaataccttaatgcccagtaggcatcgcccccgccccacagctcaagagcggccttgagccccatacttagccttgtggccttgggccttgtggccttgggacccctacatagccaggggccttgagccccctacataacttttgactttggaggagagggaaggcgactggggcagagccaaaggcggccctagaagagccctagcgtcctgggaactgggcacctccagagcaagctgcttaccaagcgaacatgtccggatattgagaaggtcagaaaatgctgtctagctccttcaggtgcaacccgccgaacgtgctggggctgaatagacgctcctgatcttggggttgcggatcctcagcggaggagtcctgggccaactcctcaggctgctgctgccagggctcctggtggccaccaccgcccttctggttctcgtggatcatggggtccgcagctcccgcgtacacgtgactttcttttcctgctcctgctccctgctcgggtttggtccgtattttcttctcatcgtctcctccagcttcagtcactgaagtctctatatccttcgcatctggaaaggaggaaagggaaagagaggtcggaggagagagctggagagagagagagagatcagggcgtttggcccagacacagggcagcctagacccgtggctgagagagacagcgcagtagcctcgggttcacgctcctctctccgggaaagttgctttccaagagttcaccaaatcaccggttcgggtccccagacaggcactgaccgtcttctttctggagctcatcgaacaggaaacccaggccgaggtcgccggtgtcttcgtggccggatctgggctggaacgccacctgggagcgtggtcgacgaagccgtgcgtctccgcggattctgcgctggggtcctctggctcctggtccgagttccggcgcgtggacttcgggtcggacgcctgcaggggacagggagtgggctgctgctcaggacgcctccggtggctgtgtgtgtgtgtgtgtgtgacagagagagagagagagagagagaggagagggagagagagagagagagaggagaggggaagagagagagagagagagagagagagagcgagccttgctggcacgcgctctcggccgggcgtggccgtaaagtcaggggcgcgctcctggtcaggcgcggggaggtggcgggcaggtgtggggaaccgcgctatattttgcggtttccttgaccactcccaccctgggcggggtgagtgccagcaggaaaaggctgagcggtctggtgggaacctatttggggcagggggaggggcggaggagcgagacccaatctagctccggagcccttggagaaagtttgcgcaacacgtctctgtccagccatccaggcaggcaggcaggccagaataatgcttccccaggagagagccgaggcaagctgaagtcagtgcacctagcggtgtgggctcccggcaccactctccccactgggtagctggtgactaatggatgagcctctccagttctgttctgttcccacccaaagtccgctaataggaccgtaattaagatgaaatgaagaggtcgaagactgcatgctaggtttctgcagcaacatccagaaagttgagggcgccacactctccaaggggtctgcggaagcgggagtttggggctgcgattttcagggcactatggatgctcagatgcaagctgcaagaaacctaacacgccccttgcaaaagctgcaggtactccacgtcagtgtacaggtatagaaccctgcctggtgtttagtgcatctaagaaggcttacactgcaagtgtcccttccataggctctagatgagactgcggagcgtgcaatgtctgctaactatgcaccgctcccacgccttaggtttcaggctcgctgcagaagcgcgagtgctccatgtgctgggtgggcactgtggacttgggttagttcccaccttcccttgctcctcatccccttctgttacccaccctcctcgtcctcctcatgcttctcctttcctactctttgcctagaacgatcattctgaccttttgctccttaatgataaaatgtcaaataaaaaagagccagggcagattgggagctccacgtttctcccttcaagaaatgtgcctcaaaacgatgaatctgtgttcagtgagctatgatagcgccacttcactcaagccactgcactccagcctgggcgacagagtgagaacctgtacctcaaaaaaaaaaaaaaaattgtgcccccagacgattctgggcccggtggtgcggacctgtaatcctagttactcctgacgcttttgcaggagatcctttgagcccaggagttcgagagcaacctgagcaacatagaaagacccccatctctaaaaatataaaaaataaaaatagctgaatgtggtggcatgcgtctgtcatccaagctactcaggatgctgaggctgggggatcgcttgatgccaggcattggaggctacagtgagctatgatcacaccactgcactccagcctgggcgactcagtgaaaccctgcttaaaaaaaaaaaggaaaagaaaagaaataaaagtaaatttaaaaaaattaaattgttccttgaaatgagttggtttcctgaatattgggataatttatccaatttttgcataaccaccattgtcatcagacccatttaataaaataaatcaaaccattttcataggcccttgaaagtatgcccactcactttgcccgctgtgccagaaagataattctctcctttctcctgttcctgagagggcagataggaaaccagctacaggatgatgggttgaccaattgactctgaaaaaactgtcaaggaatttcacccccacagactctccctgacattaaccaagatgtctcctcctcaagctgcctcttgcagggttctgcagacctcacccttctcgtggccagacaccctgtgatgaattttggcctgggatccgttattatgtgagagacttacaatgattttaatcatggtatgtattagcccagctatgacatctgttagaattggagtcctgtggtgtctcacatctgagatttccatgacttgcttcagcgctttctcagcttcagtagtcatttctgtgctcctttggtgagtgttacctaccggagcaccaaccaaggtagtatttactttaaaattttagttacattgattcacttcttgcaaatgttatgttccttattgagcgtcagccaggtaaaaataggcacaaatgatgggtttgatgtcctaaatttatgaaggcagggaccctggagccagactgctggcatctgcattacggcattgcttgtcatttgctagctagctaacctggtgagtttgttctcttgtgcttcaattttctcatctgtaaaatggagtaataataatacctacctcatggagctgttgtggagattaactgagatgatactaatggtagctcacacttacctggttcttactgtgttctaggcaacgatctaagtgatttgtttatgttaacatatttaatcctcttaacaaccctatacacacgttgatgtgctattactgtcattttacaggtggtgttattaagtcacggagatgttaaataccctgctcaaagtcactcacttgggaaatgtccagagctgggatttgaacccatcctctgagtactgtccctgacacagacgacgtgctcaataacctttgctattatgctataattagtgttcttttgtaattagtaaactagagataaacagaaatatatgtatcatttagctcaaaatttccttcacttgtttgaatatcgaattagtgccatacatatctagtggtacctctactctgttaattacttcttttactgtgcagaagctttttagtttaataaatgccatttgcatatttttttgcctgaaatgcacagtcttatttactatatccttattctttgttggaatgttgccttagaactatagaaaagtagtgatacattaaaaaaaaaacataactaagtgtctagggataagtggagataactggaatgactagcataagccagaaagccaaaaagcattctttccaactctgacatcatatttcttgttggcctaatgtgttaatgctatacataagtcatgatacctagggaaaaagtaaactacagacagcttgcgataagtggtataattagttgaatccaataagatgaaaaacatattctcaagtctaccttctaatttcttctggaaataaggagttaataatacagatatctgggagtacctaaagaactagttaagtagacacaagtaaagttaaatagagaactacatagtagctcattatataaaacccattttccccaaatctaaaccctaaccactcctaaccccttagtatttgcagagtatattaaaaaacacagatatattgaaaaacacagcaggcaagggtctctgcctttgcttcaggctctcagagagatgagagttattattcctggcagattgtagcaacaaccatccaggtgtatgtaaagaacattcttgcaaatgtgtgtaatctcctctgatctaacatcctatgggtaggtggagatgaggcaagaggaaaagactacagtagcaaatcatttcatttggatacttaataaattaagtaaactactaaattatttgaccagcttgcatttgtaattatatgccaaaaagtatgcttttttattttatattgaaatcatatttttttctttggagaagaatggaattggtggtgaagtgtcacaaagtctgaaatttacctgtgaacgtttcagcaaaaagcaaagaagcaaaagcacatgcacacatagctatagaaagaaaatatagcaaaatgttaacaaagtttgaacctacttggtgagtataccagtgttactgttcattctttaaagttttctgtatgtttgaaaattttcattaacaatttttaaaaaataaatggaaggtttcaacaaagtacataaacccaaaagccttacacttaacatctaaggctcaaatagcaacgaagtttgacttctacaataaacaataaagacccttggcttttatttcactaaagtattgccacattataagcattgccttaaaacgtctgctctcaaaaagacatttggggttatatggcaaaagtgtcaaagcaaggcactgaaagaccaaagaactccatgtaaagattatcctaaaccgaattgccttgggatttctaaaagtactgcaaacactacccaaggctgattttgtccacgtctagcgatttccccacctccgtccttggatgccggcattccaagtggctcacaatatctcccagccaaacacactgaaattcttagacttaagacaagtatgccacagagcagccttctgacactgcaactggggacaatcagtgcaccctcacttctctctccaccactcctcaacatcttccccaagatcctttattttaatttttttagagacaagatctcactctgttgtccaggctgcagtgcagtggcctgatcatggctcactgcaacctccacctcctgggctcaagctatcctcccgtctcagcctccagagtagctgggattacaggcatgcaccaccgcgcctggcgattgaaattttattttatttattttcttcaagacagagttttgctgtgttgctcaggctggtctccagctcctgggctcaagagagcctcccgcttcagcttccccaatagctgggactgcaggtgaacaccatcatgcctggcatcccccaggatccttgagccttaagtattgcacgcacctctcaggcagccacacccaccatcagagtgtggtcaagcccatgaaacctcaggcagccccactgagcttgctgacgatttcactttgcacaggctagggtggagtatggcagccccactgagcttgctgacgatttcactttgcacagggctagggtggagtatggcacccccttctccattccctgcagatcttccttaaaaaaaaaaaaagttttccttttattttttcattttagttctccatgtatgtatgtatgtatgtatgtatgtatgtatgtatgtatgtatgtatgtatttatcttgttgcccaggctggagtgcagtggcgtgatccaggctcactgcaacctccgcctcccaggtcaagtgattctcctgcctcagcctcctgagtagcagggattacaggcacgtgccacccatgcctggctaatttttgtatattcagtagagacggggtttcaccatgttagctaggcttgtcttgaactcttgacctcaggtgatccgcctgcctcagcctcccaaagtgctgggattacaggcatgagctactgcgcccggccttatttatttattttgagagggtacatgtgcaggtttgttacatggatatattatgtgatgcagaggtttgggcttctattgaacccatcatccaaatagtgaacatagtacccaatggatagtttttctttttaaaatttttatttatttatatattttttaaatgcaacgtagttgttattgtaagtgctcatccatttaaaaataaatctagactgggcatgcaatagctcatatttgtaatcccagctactcgggaggccaaagctggaggatcacttggcccaggagttcaaggttacagcgagctatgatcatgccattgcactacagtctgggtggcagcgtgagaccctgtctctaaaaacaaaacaaaacaaaacaaaataaaataaaataaatctatactgccttacatttttggattttgttttccattgacaaaaacattagaatcgatttttccaaagcactttcttttctcctataaactttaaagtaggtttaagatgtgcatactcaaaaatcatatgcttatgattctttaaattctttaaaaaacaaaattctgaaataatttttacaccttacagttcagcttaaaagtacatctgttgcagtaacaaagcattcaaccagcactttcctgacaagtgttaccataagctacataggctacaactgtgtttaagcacttttattatttcacaggagttattatgagctgccagttctcctatttgcacagttcattcacactttttaaagtagtttcatattcaccattttatttgcccctctcaattgccccctaaaggtgaggcacccaggagacttctcattcctattttaaagttgtggaaaccaaagtaggacgtaagctagttaccacactgggcccacaattcaagtctcatgagcctgcaattcatgcccaccaactgccgcttcatccccttaagctatctttcagggcaaagagaactctaactaaaaggatacaatagcttgattgccaaacctgcagcgacgacttctgtcaaaatatttaccccttgtggcccttggaagataatgtgctaagtgaactgtagagttaagatagcaaggtgtggggcaatactgacacccacttgcagataggtcagaaaatttctgttgtgcaacattcactccaacacatagttcacttgagcattatcatgatccagttatctggcttgtttgtgcaccctggttgatgcaaaggagaactcccacatagttctctaagtataattatagcaaatgtacaacatttgattaacatggcaattgattctattcatgaccctcagtcactgctggctgctgggaaaagactgagatacagaatgattttaaagatcaataaaattcttctccttaaaaaaaactcattaaaaaagtaaacaaaatcttccatttcctaaattagaggcaaaaagacttaactatggttcaccttgttctctcaagcttttactattaagctcagtttaacttccttcaaacagcaatcacttgtgtcataccccgcagttaattcacaatgtccagtttcttccatcatcataactgggacttcatgtcctgggagacaggacttaaccagtttaaagactttgatgtcagtgtagtggtccaaaggcattcagattataataatgtattgcaataattatcgagcagttactaaatatcagacttccctgtattattttatatatatcctaaattaatcctcaaaaatccatcaggcaggcactgttatatccactacttgacaagaactgaggcacaaagggtaagaaaactgcttaagttcacatagcaacaaatggccaatgaaggacttgagccagggccttaacgtcagccactacaccaaaactgcctagtcctcaactataatcccagatcaatcattaaacgaatcacatgaccttgggccagtcatttcatacctctaggcctccactgtaaaaagagacgcactaggtgagctttcacgtgctttcctgcttttaacgttctgccaatctctgcctggattgctcccctccagaataagtgctgtaactgctaagactaaaatttctcagtcactgtgagttcctgttctagtacattcctctcactcttcagggtgctagggtccagtcttcactttgggttttattttcaaatactcaactgcaatgctaatcctaaatattctctctcggtctaagatcacctttctctactactaggggtaagcaggaccgaccccactccacacttttaccccattactccagcccacatggcagctgcccaggcagcccagaaggaggcctaagaaagccctagaagcaaagccataagaataagtcagttttcctagaggtcaaacaaggctgtagggcacctgccaagcctcccgatctcgttggcagtattccatagtgtatatgtaccacattttctttgtccaatccaccgttgccaggcacctaggttgattccatgacttaactattgtgaatagtgctgtgataaacaaataagtgcaggtgtctttttggtagaatggtttctttcggatatatgcccagtaatggggctgctgggtcaaatggcagttcttttattcattattttattgtaaacttgtctttctctgttctatgttgtcagtttttgcttcatgtatttatggctctgtttttagatgaatatgtttataattgttatatatcctttactcaattttttgtttttgagacagaatcccactctgtcacccacgctggagtgcagtggtgtgatcacagctcactgcaggcctgaactcctgggctcaagtgatcctcctgcctcagcctccccagtagctgggactacaggcatgtgccaccaagccaggctaatttttttttttttggagagacagggttttgctatgttgtccaggctgtggtagttctatttttagctctttgaggactctccaaactgctttccacaggggatgatcaaatttactttcctaccaacagcatataatcattcccttttctctgcatctttgccaacatgtgtgatcttttgccttttttataatagccattatgactagtgtgagaatggcgctctgaaaactggctagccatatgcagaaaaatgaaactggactcctactcttcaccacataaaaaattaactcaagatgaatttaagacttaaatgtattttctttatatatttttttagagatgaggtctctgtcacctaggctggagtgcagtggcatgattctggctcactgcagcctcaacctcccaggctcaagtgatcttcccacctcagcctctcaagtagctgggactacaagcatgtgccccctcacccagctaatattttaactttctgtagagacggggtttcaccatcttgcccaagctggtcagactcctgggctcaagtgatcctttggccttggcatcccaatgtactagattacaggcatgagccactgcaccagattattaaagagttaactgcaagatgtcaaactataaaaatcctgtaagaaaatctagggaaaactcttctggacattgtcctaggcaaacaatttaagacctcaaaagcaagtgcaacaaaataaaaaattgacaactggggcctgattaagtgaaaaagcttctgtacagcaaaaccaacgataaacagagtaaacagtccacagaatgtgagaaatatttgcaaactatgcattcaacaaaaaactaacacccagactctaacaagaacttacaaatcaataaaaaaaaacccatcaaaaattgggcaaaggacacagacacttccctaaagacatacaagtgggaaacaaatgtgaaaaaagtattcaacctccctgtcacccttttgacagcccttacttcctactatgttcgcaattggtgggttcttggtctcactgacttccagaatgaagccgcagacccttgcggtgagtgttacagttcttaaaggtgatgtgtctggagtttgctccttctgatgttcagacatcttcggagcttcttctggtgggttcagggtctcactggcttcaggactgaaaccggagactttcaaagttgagtgttacaactcctaagccagcgcatctgaagttgttccttcctcccagcaggttcgtggtctcgctggcctcaagagcgaagctgcagaccttcgcggtaagtaccacagctcatagaggtggtgcagattcaaacaataagcagcaataaagtttattgcaaagaggaaaagcgcaacacttccacactatgaaacattaccagaccagattaccactgcaggctcaggcagcctgcttttattcccttatctggccccacccacatcctgctgattggttcattttacggagagctgattggtctgttttacagagagctgattggtccgttttgacagggtgctgattggtgcgtttacaatccctgagctagacgcaaaagttctccaagtccccactagattagctacacacagagcactgattggtgcattcacaaaccttgagccagacacagggtgctgattggtgtatttacaatcccttagctagacataaaggttctccaagtccccactagactcagggcccagctggcttcacccagtggatcccgcacctgggcggcaggtggagctgcccaccagtcccgcgccgtgtgcctgcactcctcatcccttgggcggtggatgggactgggtgctgtggagcaggaggcggcgctcgtcggggaggctcgggccgcacaggagcccacggtggaggggggctcaggcatggcaggctgcaggtcctgagccctgccccgcggggaggcagctgaggtcctgcgaaaattcgagaggtcctgcgaaaattcgagtgcagcgccggcgggccggcgctgctaggggacccggcgcaccctccacagctgctggcccgggtgctaagcccgtcactgcccggggccagtggcgctggccggccgctctgagtgcggggcaggttgagcccacgcccacccggaactcgcgctggcccgcaagcgccttacgcagccccggttcctgcccgcgcatctccctccacacctccaggcaagctgagggagccggctccagcctcggccagcccagaaaggggctcccacagtgcagtggcaggctgaagggctcctcaagcgtggccagagtgggcgccgaggccgaggaggcgccgagagggagcgaaggctgcaggggctgccagtacgctgtcacctctcactaccttgcatggatggtggagccatagtgattgggtgaccatcctggcctcactgcctgctgtgtgaccttggcttttctaataatgttctttgagtatttcagatttatctctgaggtgaaatgtgcttaatgaggcccctggaatcattctaagacccttgtccttagaaagaagctaatgatcctctcagtgtgtggctcggaggaagtgacaaaatcatgacttcctgacatgataaatggtccgctgttctgtggtccagctttcctttcaatgctcagttgctgggctgaaaagacaaccatattgactctagaatgtcagttacaatgtctgtcctcacaagggaagtcatgatcaaactgaaacaagcaaggtgttcccatgctagatgccagagacaggtttacccgtgggtgaatgatgcagttcttgtccatggtataggatgggatggtgtggtgtcaggggagggggcaagaggggcactggaagtaagagagtgggagaagaggaggggtccctgtcaaattcccctcaatcctgagagagacacttaggaacagagtgtctctgctccctctggatattcccgtgtatattttgaagcctgggaggcaggatggaggacatcctgctgatgcctgaaggatggcaaagcagaatagaaggatgctcccttaaccccatgaccgagcctctgaattaaccagctccagtgtttaacctatctctggacttatttatttttttattttaatttcaactttattaaaatacagtgtcccttttgatttcatttttttttttcagaaggaatttcactcttgttgcccaggctggagtgcaatggtgcgattttggctcaccgcaacctctgcctcccaggttcaagcgattctcctgcctcagtctcccaagtagctgggattacaggcatgcaccaccacgcccagctaattttgtatttttagtagagagggggtttctccatgttggtcaggctggtctcaaactctcgacctcaggtgatccgcctttctcagcctcccaaagtgctgggattacaggtgtgagccactgcgcccagcctacagtgtcccttttcttgtgacagtctttatctaaaacactgcagctgatcgcacacaagaaagcccacctggggaaagtattggcctccctgattggtgaaccatttttgccaacagcagcaggacagaaaacatgagagttgtcacagagacacaaatatgctgaaataaataaaaagatatcccatgttcatgtattaaaagacctgatagtgttaagatggcaatactgtttaatttgatctactccccagattgattcagtgaaatctctcaaaatcccagctaacgtcatttggaaattgacaagctgatcctaaaatgtacttgaacactgaagtgaccaagaattgccaaaataatcttgaaaaagttaaacatttagaagactcacacttcctgatcttaaaacacactacagagctacagtaatcaaaacaatgggatactaccataaggataagcatatagaccaatggaatagaatttagagtccaggaatacactcatatatgtatgggtaattgattttcaacatgggcattaaagccattcaatggggaaaaataatctttttaagaaatggttctgggaaaactggatatccacatgcaaaagaatgaagttggaccctgtataacaccatatacaaaaattaattcaaaaggaataaaaactttaagagctaaaactataaaactcttagaagaaaatatagatgcaaaattcatgacctttctatagtcaatggattcttagatatgacaccaaaagcacaagcacagaagaaagatagataaactggacatcatcaaaatttaaaacttgtgtgcctcgatggacactattggcaaaaagtgaggaggcaaaccacagagttggagaacaattttgcaaatcacacatctgataaaatatatctagaatatgtaaagaatgcttaaacttgataataaaaagacaatccagttaaaaagggggcaaaggatctgaatagacagttctctacagaaagtatacagatgcacaataagcacaagaaaacctgttcagtatcattagccataagggaaatacaagttaaaagcacaatgaagtgccatttcatatccactagatggctataataagaaagacagataatacccagtgttggtaaggatgtggaaaaattgggaccttcctacactactgtgtatgtgatgttgaaaagcaatttggtggtacctatcaacatttatacatttaaagattttttaaagcactttgcaaaaataagtaaaagaactttgctttcccttagccattccactcctgagtagtatcctacagaactactcacatatatgcctaaacaaggcatgtactatatttattgcagcagaattggaaagtttcagttagacaggaagaatgttttagaaatttattgcacagcatgatgaccacagctaataataatgtgttgtatgtttcagaattggtaagagtatattttaaacattctcatcacaaaaaataagtaggtgaagtaatggatatattcattagattgatttattctttctacaatatatacatgtatcaaaacatcacattttaccccataaatatatacaactgttatttgtcaattaaaaaatttcaacacaaattaatattaaaaataaaataaattgtaacttaaaaaaggaatcctagggcggccctcctgcccaccctctttctcccgtccatctgtctgattctcttagacttcgtgttcttttttctgtcttaatctcaacttgtttttaaactagattgctttgagaagatgactaaataaagtttccttttgattaaaaaaaaaaggaaacatcccaagtgttcactaacagaatgacctatggagaataaactaataggagaataaactaattcatagttctttccttatgaaacaactatggaataccatactacagtaaaataatgatatagactagggtttgtgaaactgatattttagattgtatagttcttagttgtgggtggctgacttgtgtgttgtaaaatgtttagccctatcgcaggtctctatcagtaggtgtcagtagcactctctcaccgcagctgtctcaaccaaaatgccactagattgccaaatgctgagggggtagcaaactagtccttagttgagaaccactgatggtagccttatatttactgatgtgaaaagaactccaagacgttttgttaaataataatttagaaatagccaggtatctctttgatgtaccaatttcatttcctttgaataaatacccagaaatggaattgctggatcatatggtaagcttcttatttaaaatttttgagaaacctccaagctgttttctataatagctgtacttatttacattcctattgaaaatgtacaagaattcccatttctccacaccctcaccaacacttgttatcatttgattttttaaataatagccattcgaatgggggtgagatgatgttgcattgtggttttgatttgcatatccctgaagattagtgatgttgagcaccttttcgtatacctgttggccatctgtatgtctttggaaaaatgtctactcaggtcctctgcccatttaaatttttttaattattatttttgctattgagttgtatgaattctttatatattttagatactggctcccttttgaatatataacttacaaatattttctcccattctgcaggttgccttttgattttgttgatgattttactgactgtgcagaaactttttcttgccgtgtaatggtgatactcatttcacaattgatatgtatatcaaaacattatgtttaacatcttaaatatatgcaatttttgtttgtagattataccttaataaagctgggaaaaaagaatgaaaatgatatgtgcaggatgattcaaattctgtttttaaaaaactatatatttgtattggtaatatgattatgtatgaggatacaaaggaaaaatgtcaaggatacatactaaattgaaaacaatggttacctcaggagagagggctaggattgcatgagtgttcatgcatgttgaaggtgtggggtaaggagaagaggggcctttggttttactgcttgaattgtcaaagtttaccaaaaatgtgcattcatagattacttatataatttaaaatgtagttaaataaacttatggaaagcattttgtagagagtaggtcaccaaagaagcctacactcttactatatcagctgccaaaagagatttggatgagtgcttaattgtacttagctcatgatttaatcctcaaatacctataatgtgcaatttctgttagggactgaaatgattatgtcatttcttttaccaatcagttataatctatatttaatataatgtcagatgattctatggaatttagaaatggaaaaaaactggcatttaaaattatagatataatgtacatcaaaaacctatcactgtgactagcacttaatacttcataaatggtacttgctaatattgttatacatgttagtatgttcgaaaacattgttccttcagcattcactagaatacaacaaaagttttatttttttctagttttttatctgaatcctatagtgtttacaattccagttaggacacttttaaaactgagatcacactttcaacattcattcatcctgtatggtatttaacaatagagtaaaaaagtaaaagctcaaattattacaagttaattgatgtttcctatagtcaaatgccacgaaaagggaggtgaagaatttggaccctaatgctgattctgaccaactctcattctttctggtcattttgtcaatctgtaagtcaacagagcagaaacagctaccattatttatttattaaaagagtgtagttgtcacttggaataaggagttgcatgttcagtgctaaaggtaaccagataatatgaagatctgtaaccagataatatgaagatctgaaaatgtataactactgtaaagatagtgatattccatgtatatacagcaattccacagatgacatcagggtctagtaagtaagaaaaaatcatttttgatattgatattttatccaatttaacatttgttctgatgctgactttaaacacacctgcactgtgtgatttatgttgtcctcatcatacaaggcaaggtttacagaaggagggaggtggctttcatgctgagagtgatactcttttattgtactactccatgttaattaggcaatgacttgttacatgacaaacttcatgtaatacagcctctagtctttattttgtgcttcacagatctcatttctctggaaaggaagaaagagaacgagtagttgtatttctattacagacagtcagggatatagaagactattaacaacattactaagtctattactaaatctgtcaatgtgtagttctgatatctttccactttgccttcggaggagaaattacacactaagtttatgtccttagatgaatttcacagctgaatagtgagggactgcaaaataaccggtgaaaatgagagttggtcagaatcagcattagggtctgaatttttcacctttctttatggtatatgctatggaaaatatcaattaacttgtaacttgagctttacctttttactctattgctaggagtgaatcatattacaactatttgaagctagaagactgtagtggtgctgtgtatcttggatttctcttgattttttgcaagtgcagttagccagaaggtttttttattttttattttattttattttattttattttatagcagttctgactgatgtggtccagctaccctcagagccactgaccttgggccaatatgttgcctactcttaagtattttgaaatactgcatggaaaaaaatgtcatttatttggttgtattactatatttaattagttgaatagatatggttagtttaatttgttaacttggctaggtgatggtacccagttattcaaacactaatctagatgctgctgtgagggtattatatagatgtggttaacatctataatcagttgctttaagtaaaggagactgtcttggataatcttggtgggcctcatccaatcagttgaaatgccttaagagcaaaactgatatgcccagaggaagaagaaattctgcctgctgactgcagcctcagtttccacctgagagtttctaggcttcccaagttccctacagattttggacttacctagctggaccccacaatcatctaaggcaattccttgaaacaaatcaaatacatatataccctgttggtttttttttttttttttttctgaaagaaccctgactaatacagattttgaaactagaagtgggatgttgctgtactaaagacctaaaatgtggaattggctttggaattaggccatggatagagactagaaaaatttttgagaagcgtgatagaaaaaaacctaaattgccctgaagagactgttgttagaaataggaatattaaagttgattgtatagaggtcttggaaagaaatgaagaaaatgttactgaaaatgggaggaaaggcaatgcttgttatacagtgacagaaaacttggctgaactatgttcttcagtcacatggaaagcagaacttgaaagtgatgaacttggatatttggcagaaatttacaggcaaaatccttaagatttttctttgtgaaccccaagatctttaccctaaaatggttctgttgaattttaccctgacaatgtaaattgatagcttatcttcataacctggtttctccttgctgcttatagtaaaatgtaatattgatacagacaggagacagggaaatactgggtagaagagggtggtttcccagcaaaggccccaccctcaagtctggaaacccgtggccctaaatgggaacaagcgttcctgtttttgtgcccaaatgctgccttttggcctgccacgcccctgtatcctgtacctgtataaactccaaaccccaggatccacaagcagatgagcagacaagcagaagagcagaggaacagaagagtggtgtggcagagaaggagagaagagaaggagcttctgaacatcaagaggagttaggctggggacggtaggagaggagatcagccaagggacgactgaactccaggggaagattatcttcccactccattccctttccagctccccatccatcctgcagagagccacctccatccagcaataaaatacgccacatttaccatccttcaatttgtctgtgtgacctgattcttcctggatgctggacaggaacccagtaccaagagggcactgagctgtttaacacttaagctgtccctggatggcagggctaaaggagcattgtaacatccctggatattgctgtaggcccagagcccaaaagtgcttgccctagctcaaatgcgtgctccccctcccataaggggtttgagcatgcagtggccaaacagacgagccacacccctgttgcaggccctgcaaggggggtcagtgaactctcccatttcaatgtgaaagatataaattgaggaaagaactattaggcaaaaagtaactagcacttgattttggaggttctcagcctatcgtgattccaaaggatgccaaaattagaaaatttattgtcgcaaaagcatactctgaagagaaggccaacagtatggctggacaatcttgctaaagagattatatatgtgattcatggatccaatcaaccatatcagctgaaggcaggaatagagatgggtttatccaggaaggatcttgtctaatgacatggactcccataacacacacgagactgataaggattttgagaatgttatatcaacagaaatactggcatcttggagtaaaggagatagatatgggatgaaatgaaggaagactgttggacttctggaaatctataggcaggatatgagctgacagggctactagactgcaaagacacattagccttcaagaaaaaggaagagtgaattatgagggtggcacagaagctggtggatcactgcaagaccagatggcagaacattgagctaaagaggattgttcctaggccttgaaatctaatggaattagctatgctaattatttatttatttacttttttgagatgaaatctcattctgtcacgcaggctggagtgcagtggtacaatctcagctcactgcaacctccacctgccaggttcaagcaattctcctgcctcagcttcctgagtagctgggatgacaggaactcaccacaatgcccctctaatttttgtattttagtagagacgaggaggggggtttcaccatgttacccaggctggtctcgaactcctgacctcaagtgatccactcacctcagcatcacaaagtgctgggattataggcgtgagccaccacacctggccctgccatgctaaattttgaacttacttgggacaagaaaccactttatgcctcccatattcattcttttggaatggtaatgtcttgtaaaaggaaaataaatctcaggactccaaaatcattaagccaaagggaaaagtcaagctgggaactgcatcaggcaaacctacctcccattttattcttaaataagatagctacaaacaaaaaaaaaagctacatacatgtctcacaatttgtccactgggacattccttttgagccccaagatgtttaccttaaaatggttctgttgaattttaccctgacaatgtaaattgatagcttatcttcacaggttctagacaaagaacagaactcaaagtcatccttctgttcatctgagacagatgcatatctgattgctttcctaatgtaaaaatgcagattcactgagctgacaaaggcataagtaactattcctctacccttctctcacatgtaaactgtgtattcagtgaaaggtttatcaaacactcaaaataatgcaaccatttgtctgttatctacccacacctttaattttttttccttttcccccaatatctgcccttttgcctttaaatactgaagtccacaaaatcttctttggaaaaaggcatagacctgccttccagatgcatgttcttaaccttggtaaaataaaatttccaagttaattgagacctagctcagatactttttggtttacaaattggtaaccaccaagggattctgagtggaggtgcccctgacctttgacaaatcttctattactgcttggtaccagcttgagatatctttattgctcaaatcaataggcagatttgctgaggcctgggaacttcccccctccagacaatcccttgtagcaggacgagctgcagacaaaatctttcagacactgagttgtagaaggaagggctttattcagctgggagcatcggcaagctactgtcttaaaatccgagctcctcgagtgcacagtttctgtcctttttaagggctcataacactaaagatttcacatgaaagggtcgtgattgattgagcaatctagggggtatgtgacaggggcttcatgcaccggtagtcagagtgaaacagaacagagcagggagtttcacagcgttcttccatacaatgtctggaatctatggataacatcggttgctaagtcatgagttgatttttaactactaggtttaggccaggcaggcccaggcctggtttcagttctggttttgggtctggtgcctggctgcctgcccttggtttcacttccttgtttttttcttaaaacaggtactgagtataaaacaatataaaacaatatgagagggtccgtctcttccctcaccctgatctccccaaatttggtcgatatctaaggtttttttttgctgtacaactccttttctggagttttactcactttcaacaaggaaggtgagttttcctgcttccatgatgatggagggcaggcaactcctttctggagtttcagctcaattccaacagggaaggcgagttggagtttttttcctgcttataggctggtagagagcagtgttgagcctggactccattcctaggtaagtagctgaattggggttttatcttgaaaattctccttaatgacctaaagttaagattaacaaccagcagctcttaatttctccttaccattagagtgctcaggaattgtatacatagtatgatcatttgtttgttttgccaaactgttttttcatttatttgtttgttttgttgttttggtctttttcccattggatttgactaactctacccaactatatcaaatgtgaaggaaagttacaaatggtgaggaacaacgcctctgcattgggtaaattcctgcagctgggggggaaaagggaaaaggataaacagccatcaacaggaaaaaagaaagattttgactacctgaggggctttatttacataacaaggccaccttttgctagccaagccaaactgtgctccacactgcagttctgtagctaaggttttgcccttttttccaccacaacagcctgggtttggttcctaaatcaagttctttctggtttgatatttgtgttatttttgaaatatcagcaatttgttccagctaaaatagggtagtgagatttagaagaattttttaagagcttagtggctaaaagtcagtttaattaaaagctaatatccacgatgtgtgtgtgtgtgtgtatatttaaaaggcctttatggttttttgttttgttttgtttgtttgagaaggagtttcactcttgttgcccaggctggagtgcaatggtgcgatcttggctcactgcaacctctacctcccgggttcaagcaattctcctgcctcggcctcccaaatagctgggattacaggcatacgacaccacacccagttaattttgtatttttagtagagatgggatttctccatgttggtcaggctggtctcaaactcccgacaacctcaggtaatctgccttcctcagcctcccaaaatgctgggattacaggcgtaagccaccgtgcctggcctgttttttttttctctcctagtaccttgttttttgagaaaaaggttttttccttctcagtcagtcaaatgaattctgttttctccatttacttctgcctatctctcctttctcttgttcccctctgctgcatgagggacccaaaatagtttctaacagcctgtaattccttaaataaaacagagaaggcactagagtcctttttgaggagaaacatctgtttttccttatggaaccccaagagtctaaacagacaagttcctctcagatcttaaactgcttgcttttgtactgtgttacctgatttttggactaagttattacaacagaggctactcttcgggtgtttaagataagaaaaggtatactttagacacttagaggaaagtctttgtaacaaagtgcagtgcaaatgcatcacatggtctagaatcatgataattctatcttttggagatccaggattcagcgtgggctctgcccagagctgagatccagttaaaagctagagactaggctgggcacagtggctcatgcctgtaatcccagcactttgggaggccaaggtgggcagatcacgaggtcaggagttcaagaccaacctggccaacatggtaaaaccccatctctactaaaaatacaaaaattagcggggcatggtggcaagtgcctgtaatcccagacacttgggaggctgagggcatgcccagccgatgctacacttttaaacagccagatgtcatgattactcactatcattagaacaaaactagaggggaaatctgcccctatgatctaatcgcctctcaccaggccccatctccaacactggggactacaatttgatatgcctttgcaatatcaattgctgcataccaagttctctctgttttgggcctctgtaatagtcacaatgtcaggtactgctggtgccaaaggtggtattacgcattgagctgcctaaaatcagtggtaagtctccaagaaaccaaggtcttgtgcacaggccagatggggctattgaatggagaaacagtctcatgaaacattttggcttccttaagctcagcaatgatggcaattattctttttctcccctaggcagctgacattgttttttgggaaacaacagtactaggtgttggtcatcagatgggtccatggtcttctatatttctcactaagatggccataactattgcaattcctgtcagggcttggaggcaaaggcaagtggggctgcacatggaaaacacatcactgccaatatttcattcagtagtgggggccatgacaacggaggttagtaggagcccaaagtcagagaacacgatctgttttctcctcatcttgatgcaagggtttgtggggatcacagtcacctgtgtactggtatctaaaaggcctaagaagtgcaattcctctccactgttcagttgaactctaaccttggcatagggcctctgggtcccctgagtacagaaggatcttgtttataacccctaaaatctttggatttttgtttgtaacccctaatcttgtttatatttgaaagctgagtgtcagagcaaaagttgctcaggatctctgatttgtctccaaatccaccaggagaggtggaaggccatcactgtgcagactctagcgggaccacttatcaaatccccatggcctggtacttggccctgaattttttagtggggagcccatcaatctgctttcgtggttccattattgagtaatcagactcagagatctctttgggaaggcccttgcccagacagtccagaagagggcactcaagtactatttttatgctccctttttggaggggaggggtcaaattttgctattttatcggaagccatttcttctgtgcctgagaatttctgagttaagatctggatcacactgcagattgatggacttgacctcaggaggtggcttaattgggcttgacaacaagcaggagcagcatgaacaaacccgtaaatctaagtctggttaatcttctcatctaccgttcccactccctcgtagtagacccaagagaccaccaggagggctgcaggacctccatagtctctgcgaaggtggttgagacatgtttttcagtgactaggtactcattatgtgtggaccaaatctgtcagagaccaaatagtacccagctgaggaaagagatggtcgttggtatacatacactctcatctccccaccttgctcctcctcctcagagaaagtggccactatcaaggcactatggaggagggggtctgtagtgatgtacccctcaaggagccactttcctttatgaagtttatttaacaagattacctttttcgtaatggaagcaaactagccaagtctctgtggtttcttcccctaagcaagtcttccttctggcttggctgctgggcattgaccctatctagtgagatcactggacaaagtgattctaaagagctctacattatttttattagaagcatgagtctcagtaacatgctgcatggcatgttgtccgtcagccccagggaactgcttagatctaggaatagttttggggtacaggtcagtttacagggtctccaacgacttctggccccatcatcagagaacggtgtccagggaattgtttctgtggcttcttagagcccctctgctggatctcttatttgatccactaggttatctcagccgaggtgatggggataaacaggaggaccgatggttaccttggaaccaaaagcttttataaacaattttctatcatcctccaagtataccctgtgacttacaatagcaattcctgagacctgctggcatggctggtaaagtgccacgtgaggtctgctagcacttcccaggactcactggcagagtgcccggtcagatcctctgactctggcaaataatccattagcatcctccaggagtgccctgcaaggtctgcttacacccatcattagtgaattgccccacgagattttcaggctctttgctcttcagaaacgacattgtgcataatcaactacccagcttgccattccaatttttcaagagctcagctgagctagagagagctgagctgctgggtgtcagagtagtcgattaagacgagtcaaaataaaagtaacagtcagactttaataactgcctttgatagtataagcaagggactgaaccagaaaaagtaccgactcctccattattccatttttccacatggggtggctccaacaggggtctgaccacagatgcagggcatcatcatctcactgttaagggagccctgaacaagaggctcctgccattttatggacccaggggcaggaggaggtgacagggaagggctaggagtagaaaagtactgagtactgagtcagcttgaagaaaaaaatatttttaggcatcccccactcccaccatggcaacaagaggtcttagctcaggtgcttgagaaaggcctctgccaaaggctcctgataaggcggactccaaatggaggcatctggtctaggaatgccgacatgtgtgagagcatgatcagttcgggacgtctgagtccttgactgcaactccattcacagactgcaatgcacggctgtgcatcaggtctgatgtggggagggcacgtccccccatgatccctgccaggtaaagcttttgtaattgcctatggcgaggcctgaaagatcacccataggtttttggccaagagttgaattcactctctccagtggtcctagcacttcctgtgagaggtcttgctgtcattgtctctaaaagcatgaaacaaaggaagtcagatctctgcccctttggaatgcagctactgtggggctacgtgtttctagtttccattacagaaatactgaatccacccgtgcccctaccacacccacaccgggaactcaggagaaggggaggcagggctgtggtttctggcctgctgtggcactagaaggttcatagcggtgagtctgatcggctttctgggtgtcagaccagacggaagaaccaaagccagtcaccatcatcagtagtattctagctctggagcttacgtgttcaccaatgacagtgtctgcccaaatcttccttctggcttggctgctgggcattgaccctacctagcggaagcttaggacacacctatccctggaattctgggcaaattctcccagctcaggagagtggtgggctgtttttggttcctctgctttttaaattctatctgttatggttagtatcaggcctctgagcccaagctaagccatcgtaacccctgtgacctgcacgtatacatccagatggcctgaagcaagtgaagaatcacaaaagaagtgaaaatggccggttcctgccttaactgatgacattccaccattgtgatttgttcctgccccaccttaactgagcaattaaccttgtgaaattccttcacctggctccaaacctcccccactgagcaccttgtggcccctgcccctgcccataagagaaaaacccactttgattgtaatttttcactacctacccaaatcctataaaacagccccacccacccctatctcccttcactgactctctttttggactcagcccgcctgcacccaggtaaaataaacagccccgttgctcacacaaagcctgtttggtggtctcttcacatggacgtgcatgaaatttagtcccttaatcatcatcactgtggaaggtaatgtttattaaacacctacagcatggcaggccttgttctgagtgttctacttgaatctcttcatttcatcttcttttcagccctatgaactaattactgtgaaaattccattgtacagatgaggctcagaaagctaaaacaacctgcctaaagtcacaaatccagtaagtggcagatctgtgacttgaaaccctctgtctgcattgagagtctctgttcctcctatttagccacactgactcccatacttctgaaaccgcctttgcaaaattatgactaagacagtgaaagagatttaacttaaccaactccattttgcttctaacctccaagctgtccttgttcattcctgggcgtaggcccaactaaccttggagaaaaacttagtttatagtttgaacaaagatggtaatagcctttcccaaagcagacttccttcttgcctgggaactagattgcctttgtaggaccaacattggccacaagactagaaattatagtttaggagtcatgcagctggaggctacaagattctaacccttcctaaactgctcctaagatcagtggttgagatattttgtaaaccctgcacttgatggatcagctggcaccacccaaatggataaactggctcatctgatcttgtggccgccacccaggaactgactcagcacaagaagacagcttcgactcgctatgatttcatctccggccaatcagcactcctggctcactggcttccccccacccaccaagttatccttaaaaactctgctccctgaatgctcgagaagactgatttaggtaataataaaactccagtctcccacacagccggttctgcatgaattactctttctctattgcaattcccctgtcttcataaatcggctctgcctaggcagtgggcaaggtaaaccccttgggcagttacacttcctcctcccaccccagtgccctgacccctccatgccatctcagcagcatgatgtttacatatgggtcctagatttgtgtagtgttttccaggcagcaagcttagtatttcttcctggatacagaggacattcaacgaagcacttccctttctgtattgcaattaagaccaattgtcttaaggtgggaaactactccacatacaaagcatagtggttaaaggcaggggttctgatacttggagatgtcagggactaataaagttaataaaattgggtcctgacataggttattatctttttatttcactaattaaggacatttaaaacaaca[132 bp omitted]aagaactagtctccacacataataaaaaagttagctgggtgtggtggtgtgtgcctgtggtcccagctacttgggaggctaaggcaggaggagtacttgagcctgggaggttgaggctgcagtgagctgtgattgcaccactgcactccagcctgggtgacagagtgaggctgaaacggcttttgcaaaaattacaacactgagaaaattatagcagtgaaagagatctgatcatgccaaagtcccatcttgcctttggccttcaagctgcccctaattattcctgggttaggccaagctaacctggagagacatttagtttatactttaaatgataatagccctttcccaaaattcaactgcctttgtaaagctaatgagagaccaccaggctagggggatagaggagcctaaattctgctaaggtgtagacataaacgattgccagctattgttctggaggtcacaagatatgctacttccccaattactcctccagataacattactattgtagaacctaagactggccttttgagatatcttttcagatttgtttgcctgtctgacaccaatggcttcacctggacctgccagccactcctgtggccccacccagaagatattcagtgggcagaaggaccattcctgcacccttatgattgcacccccaaccaatcagcagcaagcacccattgcttagccaccctaactccctccctaaaactatctttggaaaaccctacccctaaatgctcaagaagattgatttgagtaacaattctatctcccatgtggcgtggccagccttgcatcaattaaattcttttatttactaccatgccatggtcttcatttgtgcagcaggcaggaagaacccatcaggtggttacaatcctctctcaaaatatttaataacagaaataatatctaaaccttgtaaagaaagattacaatgtggcaggttctgctctcagtctttcaatgaaatatctgattcaatcctcataaaaatcctgttcagtaagcttgttatccccattttataggcaaggaaattgaagaaaaagaaacaatatgtaaattgcttctgcctctgctgataaccattatagttagcatactataatatactgtctctctctttcataaaagacaagagtaacctttaggcccacaagggaggccctgatctcagaatttaggaatagccaagtaaaacacagacacctctgagtttgagccttgggaaaatgagcattgtgtctgtttcctgaaatttaagatgaaaacactaatatctgttgtgaggagtaaatgacaacatataccgagtatttacacagtaactggcacataagaacctccgaatacataccagctgtaaggcttattgtcactcttcctccttgcacagccctatgagttcatctcttgctgggaaggagctgagtatggatactacagactggtcctgttattgaggtcagataaatttgatgttcctccttccctcactctctcccatttcctcctccttgaccgaactgaaacgggcagaaatatttgggctttacttcccattggttgaaattgttgctataacagcattcataagcattctttctgggaaccctgggtaagagctgcttaaagacttctgaggcttcttcagctactgctgctggtactccaaacaaggatctgatcattcatgtatcagagtttgttaggaatggggactgtctacaaaaaaaagtacctacagtggttctccccattcatcaccaagaccccacacttgaccatgctcccagctctttctgcccattctgcctacctagcatctcattaggaaggtacagataaaaaaagagctagaaaaggtcattgggaggatcaagaatgatttgtccccacagatatgtaaggataaaatcctagtattttccttctcccgttggaacacagggctccatggagaaagttctaaagagggtcttcccatggacaaagacttcgccttaattgcttggtgttggcggtcatgattttgactcctggttaattcatcaagagccattttgccaaaatccaagtcacagaatgaccaagtgaacaagtgagccattcttggagcaatcaagttgccaatgactagttcatgcaagcttaagaaattaactgatttacaaaacactttgttgtttttgcagagtttactacaatttactctgagtgaatgggcatggcataagggctatggagagccagttctataatgttctgtgccttcagacatatcctctcccatcggtcggtctttccccagtctggaatgggcagtttcaggagactgttttcccccagtagatgaccctctctcccatccccaacccacagctacagcaacaggaacttagctgaagccatccagctgacgcccaagaccattccagtcaatgaactaaggacaagcgtatgagtgtccccccacccccatcccaaccccatgctccagacctaccctcatggccactgagtgggacactggaaactttgccttcctgagagaacggggctctctctgagagtggaaacatctctgttgtcttggctcccagactgctgccaccacagtgcaaccacccaaagcaaagggaatcatggaagctatttcacgtatgctgacaaagccctgccccagtcctaggggacctcccaccaatgtgaagaggtgtgtgtgtgtgtaatacaattgtgggggcttttttctttttttttttttattgtactttaagttctagggtacatgtgcacaacatgcaggtttgttacatatgtatacatgtgccatgttggtgtgctgcacccattaactcgtcatttaatattcggtatatctcctaatgctatccctcccccctccccccaccccacaacaggccccggtgtgtgatgttccccttcctgtgtccatgtgttctcattgttcaattcccacctatgagtgagaatatgcggtgtttggtttttggccttgtgatagtttgctgagaatgatggtttccagctttatccatgtccctacaaaggacgtgaactcatcattttttatggctgcatagtattccatggtgtatatgtgccacgttttcttaatccagtctatcattgttggacatttgggttggttccaagtctttgctattgtgaatagtgccacaataaacatacgtgtgcatgtatctttatagcagcatgacttacaatcctttgtgtatacacccagtaatgggatggctgggtcaaatggtatttctagttctagatccctgaggaatcgccacactgtcttccacaatggttgaactagtttacagtctcaccaacagtgtaaaactgttcctatttctccacatcctctccagcacctgttgtttcctgactttttaatgatcgccattctaactggtgtgagatggtatctcgttgtggttttaatttgcatttctctgatggccagtgatgatgagcattttttcatgtgtcttttggctgcataaatgtcttctttcaagaagtgtctgttcatatcctttgcccactttttgatgggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttcgttgccattgcttttggtgttttagacatgaagtccttgaccatgcctatgtcctgaatggtattgcctggttttcttctagggtttttatggttttaggtctaacatttaagtctttaatccatcttgaattaatttttatataaggcgtaaggaagggatccagtttcagctttctacatatggcaagccagttttcccagcaccatttattaaatagggaatcctttccccatttcttgtttttgtcaggtttgtcaaagatcagatagttgtagataacaggactctgttctgttccattggtctatatctctgttttggtaccagtaccatgctgttttgattactgtagccttgtagtatagtttgaagtcaggtagcatgatgcctccagctttgttcttttggcttaggattgacttggcaatgcaagctcttttttggttccatatgaactttaaagtagttttttccaattctgtgaagaaagtcattagtagcttgatggggatggcattgaatctataaattaccttgggcagtatggccattttcacgatattgattcttcctacccatgagcatggaatgttcttccatttgtttgtatcctcttttatttcattgagcagtggtttgtagttctgcttgaagaggtccttcacatcccttgtaagttggattcctaggtattttattctctttgaagcaattctgaatgggagttcactcatgatttggctctctgtttgtctgttattagtgtataagaatgcttgtgatttttgcacattgattttgtatcctgagactttgctgaagttgcctatcagcttaaggagatttggggctgagacgatggcgttttctaaatatacagtcatgtcatctgcaaacagggacaatttgacttcctcttttcctaattgaataccctttatttccttctcctgcctgattgccctggccagaacttccaacactatattgaataggagtggtgagagagggcatccctgtcttgtgccagttttcaaagggaatgcttccagtttttgcccattcagtatgatattggctgtgggtctgtcatagatagctcttattattttgagatacatcccatcaatacctaatttattgagagtttttagcatgaagggctgttgaattttgtcaaaggccttttctgcatctattgagataatcatgtggtttttgtcattggttctgtttatatgctggattacgtttagtgatttgcgtaagttgaaccagccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcagcatgatgctggcctcataaaatgagttagggaggattccctctttttctattgattggaacagtttcagaaggaatggtaccagctcctccttgtccctctggtagaattcggccatgaatccatctggtcctggactttttttggttggtaagctattaattattgcctcaatttcagagcctgttattggtctattcagagattcaacttcttcctggtttagtcttgggagggtgtaggtgtcgaggaatttatccatttcttctagattttccagtttatttgcgtagaggtgtttatagtattcgctgatggcagtttgtatttctgtgggatcagtggtgatatcccctttatcattttttattgcgtctatttgattctcctctcttttattctttattagtcttgctagcggtctatcaattttgttgatcttttcaaaaaaccagctcctggattcgttgattttttgaagggttttttgtgtctctatttccttcagttctgctctgatcttagttatttcttgccttctgctagcttttgaatgtgtttgctcttgcttctcaagtccttttaattgtgatgttagggtgtcaattttagatctttcctgctttctcttgtgggcatttagtgctataaatttccctctacacactgttttgaatgtgtcccagagattctggtatgttttgtctttgttctcgttggtttcaaagaacatctttatttctgccttcatttcattatgtacccagtagtcattcagaagcaggttgttcagtttccatgtagttgagtggtctcgagtgagtttcttaatcctgagttctagtttgattgcgctgtggtccgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtcttggagtctaagtctctttgtcggtctctaaggacttgctttatgaatctgggtgctcccgtattgggtgcatatatatttaggatagttagctctcttgttgaattgatccctttaccattatgtaatggccttctttgtctcttttgatctttgttggtttaaagtctgttttatcagagaatagggttgcaacccctgcctttttttgttttccatttgcttggtagatcttcctccatccctttattttgagcctatgtgtgtctctgcacgtgagatgggtttcctgaatacagcacactgatgggtgtgctctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcattttgcttgtctgtaaaggattttatttctccttcacctatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttactagattggggaagttctcttggataatatcctgcagagtgttttccaacttggttccattctccccgtcactttcaggtacaccaatcaggtgtagatttggtcttttcacatagtcccatatttcttggaggctttgttcatttctttttattcttttttctctaaacttctcttctcgcttcatttcattcatttgatcttccgtcactgataccctttcttccagttgatggaatcagctactgaggcttgtgcattcatcatgtagttctcgggctgtggttttcagctccatcaggtcctttaaggacttctctgcattggttattctagttagccattcgtctaattttttttcaaggtttttaacttctttgccatgggttcgaacttcctcctttagctcagagtagtttgattgtctgaagccttcttctctcaagtcgtcaaagtcattctccatccagctttgttccattgctggtgaggagctgcgttcctttggaggaggagaggcgctctgatttttagagtttccagtttttctgctctgttttttccccatctttgtggttttatctacctttggtctttgatgatggtgacgtacagatggggttttggtgtggatgtcctttctgtttgttggttttccttctaacagtcaggaccctcagctgcaggtcttttggagtttgctggatgtccactccagaccctgtttgcctgggtatcagcagcagaggctccagaacagcggatattggtgaacagaaaatgttgctgcctgataattcctctggaagtttcatctcagaggagtacccggccgtgtgaggtgtcagtctgcccctactggggggtgcctcccagttaggctactcgggggtcagggacccacttgaggaggcagtctgtccgttctccgatctcaagctgcatgctgggagaaccactactctcttcaaagctgtcagacagcgacatttaagtctgcagaggtttctgctgccttctgtttggctatgccctgcccccagaggtggagtctacagaggcaggtgggcctccttgagctgcggtgggatccacccagttcgagcttcccggccgctttgtttacctactcgagcctcagcaatggcaggcgcccctcccccagcctcgctgccgccttgcagtttgatctcagactgctgtgctagcaatgagcgaggctccgtgggcgtaggaccctccgagtcaggcgtgggacataatctcctggtgtgctgtttgctaagaccattggaaaagcgcagtattagggtgggagtgacctgattttccaggtgccatctgtcacccctttctttgactaggaaagggaattccccgaccccttgcgcttcccgggtgaggcgacgatgcctcaccctgcttcggctcatactcggtgcgctgcacccactgtcctgtacccactgtctgacactctccagtgagatgaaaccagtacctcagttgggaatgcagaaatcacccatcttctgcgtcgctcacgctgggagctgtagactggagctgttcctattcggccatcttggctccaccagttgtgggttttgttttcttcagtgccatcttgacccaattttgaggccctggctagaggctagtcagttcctcttcttgagcagctgattaaatccacatctcaaccatttcccttatggggctctcacattcctggcaactatgtacctgccctaatcaccacagggataggtaccagacaactagggacagcccttttgcctaagtttcaaattaacaaatccacagggagcccatgaaacctcccttgccatacctggactgcctcctacaggtatagctctatcctgcgttacaacttcaggtgtggctctacctggcagccttctctcatttggagctgtaagtaacaaagagttctgcctttcatctatctgaatatatttatgtggtatccttccatccaaggaccctatgttcctgtctaacattttataattatgaaacaatatgggcataaagaggacaataagggaatctagtcccctgcttgtttctgattttacatgaggctctccaaatttaaggtgggtaggggaccataagtggatataaatacaattgccaacagcccacaaatgtggctctgggcactatgtcaatgagttagccctgcttcacaaggaacagctccagttaagtaaaagattgctgtttaataccaccaagtcacccttgaattctttcctgggcaaagccaagaactctcccaggctaagccccagtctgggggcttgcctgccccacgtcatctgaacacatactccaagtaattttctaggtttaacagaatttcaattaacacagaaagataagcaagaaaacacacggtcgacctaaaaataagtatggaattcacttaactacatatttattagaaagacaaaacattaatctttaagactgacgatgactgaaaaatgaaatactagtcaatcaaaaagagatgtctgaagtagctgttggcatatatgacattaacaggtgccaaatatatatgtagaatgatggaagaaatattgttttccttgttttgaaaaaagaagaatggcttctgattgcttctgaatgcgagtacatgaaattgcaggaaatactccacaaagtagttgtatatatactgttacataaaccatatcaatatactgaaacactaaacaaaatatgcatatcttggaatgatgggattcaaacaagcagacctatggctgtattcaagctttgatcatgtcttactttttaacacgtgagacttccaaatcccagtgatactgtgagttcacaaactgcttagcattcacccgggcaaaggaaaatggctttatcttttgaaaaagatgtcttaatccacagttaacttttttttttttttaagagagaggatctcactctgttgcccatgctggagtgcaggagcgcgatcatagcttattacagcctcgaacttctgggttcaagtgacactattaacgttattttctaaaacaacattttttcagttttcctttcttattatattcattgcatatatgttgccttacttcctaacagacaataaatggatgggttaatgattataaagaaaaaaatggcagcacagaaaagggaatctaatgagcaaatagaagaatgaaagaaaaatatctagtacatacccagcagtctattctgtttaatttgtatccagaaatattgtgtacttatatattaaaatgaatccttaattcagcataatacccaagggttagatttagtctggttaatggactgttttaaagaaatgagattgaacaagaatcccatgtcattgtttatttcctcattttctttttattttaattaactaatttagagatggggtcctgctctgttacccaggctggagtgcagcggtctgatcatagctcactgcagctttgaactcctgggctcaagcaatcctcctatctcagcctcccaaagagctgggactacatacaggtgcatgccaccacacccagctatttttttcctagagatggggtctcactatgttgcccaggctggtctcaaactcttggcctcaagcaatccccccacctcagcctcccaaagtgctgggattacaggcatgagccactgtgcacagcttatttccttattttctgttgaaaaaaaatgtgagattatgtatgtctattttcccctcacatttgagtctactgaacagaatgggatgtttggtcaatgaattccattatagccacttgtcagctgtgatttggacagattatttaatctctctctgtctttatttcttcatttgtgaaatagcaataagcttaattcacacacagtacttgtcacacattaagccttccaaaaattttagctgttacgataatcattgcccttttaaaaattacacataaagcaccactgctagcttccgtgaaggaaacaagaagagtaggagacccagtctgaaaatgcaagtgcttaccatgcaggtagggaacataagaattacacccacaaaacagttatgtttcagtgagaggccataagtcatgactgttgcctcttaattagcgattgagacttcaggtctacagggggtctggaaggggagacaattgggcaggtgaggttgagaaacagaaggaaaaagaagaagatgggtgaaaggaggcagaaaatgtgagaggaaaacagacatgaatgatttggctagatgaggaaaggagtataggaacagcacaagcaaagatagtcagaaatgagcatggtatattccagagattcactgtgagtttgtagtgtctaatatggtttggctgtgtccccatccaaaatcttatcttgaattgtaatccccataatcccaatgtgtcaagggcaggaccaggtggaggtaactggatcacgggggtggtttcccccattccgtcctcatgattgtgaatgagtctcgcaagatctgatggttttataaacatctggcatttcccctgcttgcacttcctccatcttgctgccctgtgaagaaagtgcctgcttctcctttgccttctgccacgattgtaagtttcctgaggcctccccagccatgcagaacagtgagtcaattaaacctccttcctttataaattacccgggcttgggcatttcttcatagcagtgtgagaacagactaatacagtgtctaagagccatcactccaaagagcaaactttattgccatggcgttagctgaaaaacacttaggctattagattgaatgtgtgctgatccctgagactttctctaaatagttatataaagcaacacatatggaaaaaacagctaagcaaagaaaaagattcagcagaggaaaagtggctttcttggttatttatcttttcctgcaataagtatgcaatcatgattaattcaagttccctcctagtgttattctatttaactgagatattgatgtacaatattagaatgctaccaattgtgagagggaacaagacagtttgggcatggtgcctaaatatcaggagggtgttaaaagagttattcagagtatcatttttattttgcctatggattgagtctttcctatggttcataggggaaagaatggtgagaaggagcagagtgagatgaatgaaatttgatctctgtcgttggctgtggttgctactcttggacagtaactcgatgaccatgaagaagacttcctcatttcatcacatcctgcatgttgactaggatcacagctggcagctagtctccttccttccagttcagaatgaatggactaaacatttacttagtggagagttatgcaaaattttgatactatagaatgtgttcacctaacgggttgagccaagaagaggctcctaaatctaagtctgtatgttaaataaatagaagagacgatttagcatcttacaatatttctgtcggactcacttttggagttgacctttttgatgtggcgggtaggcctgtggaatttctgagaaatccttggaaattctttgtgcttaaaatgaatagaatcatattttgtgctccttgaggtgctggggttggggacctgggccagggaaaatcagattgtgaaacctccactcagtctttactttcctttcttccttataaataatttcaatcccactgaaaccccttaatgtgaccagatgagttaaagggaggatagggatcagaggtaaagagaaattggtcttactgcttggcctcgtgatgagggctatggaaggagatgttagggactgatttatatagggaccagagttccatttttcctttttttttttaatggtaaagcccagctggccagagctacctccttgtgccccactggctaccttccagaggcagtacctagctgctagccgctgtttatcatcaagctccccacacctcaacaacagctccaggctcagccattgccatggatttctttcctcctatgtctccacagactctttcaccttttgattttaaaacatcctttgtttaatttttttgtttctctcgttcaaagggaatggacagagactcttccttgttctctgccttccctccattattttgcctaaaccaagattcttcggcttgaaacaaaaaatcataatccaactctgcagttctcatagaggccctagttttgtctgtggcctgtgctttagaggggtccaaatgtatcaattatgatgctcacacctgaatgctacctctgaaatcatctttgtccccttgcttgtgtaacacaacagaacgtgcttttagaaggggtcttttgtattactagattctaaaatattgacagaacaatttccaacctgttagcctgctttcttaaaaaagttaattcaacaccaagcaccaagctagttattgttcatgtgttgtgcttccagcttcaggcacagatttgcaagaagattgggagaaatgagagttgtgaggagggtacaagttgtatcactccctcaagggcctgtaagaatggacaccaagatactgaatgcctttaggggaggttgtttactattcctagaggtaaaatggcccagtgccatgattggggaagggacttgaatcttcaaccctttaagtgaaatagttctgggctagataatgtggtaggtgctgaagagctgaacttgggctggtgtgtgtttctcttaattgaatgatctctggcccaggggagggcatggccattcagcggctggcctcttctaagctgagctatgtgtgttctcttacgtaggccactccattgctctgggcctgcagaaagccctctacagtgctgtataaaggatatagtcaaaagcaggtcagtataacagagttcattttagtggaattcaaatgtaccattggccaaatctctacatcaggataaccgtgttttgggtccatattcccaatactgttttcataaaatagttttagtatatttgcaaaagggaggagagcatctgctaaaagtttcttggggaaattcatgctatagtttggaaatagataaaaacatactttgttttcactttaaaaaaaatcttcggctgggtgcagtagcacacacctgtaatcccagcactttgggaggcagaggcaagaggatcacttgagcccaggagtttgagatcaacctgggcaacatggcaaaatcctatctctacaaagaatacagaaactaggtgagtgtggtgctgcatgcctgtagtccgagctactcgggaggctgaggtggaaggatcacctgagcctgtgaggtcaaggctacagtgagccaagattgtgccactgcaccccagcctaagagatagagtgagaccctgtctcaaaaaaaatattttgtttggttcattttccctccagaactccatagaggactgtataaattcacataaggagaaaaagcaactcaccaaaccttaagatggtttctcaaaattcccagaccctggtatacacacatattctcccataccaggacactgaatgcctttggaggaggttgattactttctttagaggtaaaaaggctcaggcttaagacagagccttgagcctgcaggcctttgaaggaaagcattctgggcaggatggacttggtaagtgctgaggagctgaatctgatatagtgagcacttcctgtatctgggtgactggggagctaaggaagggcatggccacttagaagctggccttctccagggtgcagtctatatgttctcttttgcagaccactcccttgctgtgggcctgtgttccttcatctgtaaagtgaaaagagtaggctcgatgttccctaaattctctccattgtttacgcaacacatcctccaggaaggactccctagccaacacaggtgggactggggacgaagtgtgggcttgtcccttcagatatcccaccctcaacagacagattgtaccataagagcagaaaacatgcctgggtcatctttgtgaccccatcgtctagccaggagctgggaacagagcaggtatctccaacagtctgtgtaatatatacatgagaaactgttcaggcaagtaatcttgacaacccctctagcaaagttctgctgttcttttcaaacctctccattcacgaaatcaagtggtggctaagacatggtcatcagataacactgagctcaaatcctggccctttcaggatctttggcaggtcatctatagcagatgttgtctgtgtcctactagatctcagccatatgtacttggcccaatttgcaacagcttgatgcttcctctggggtctgaagcccctctgcctgaacagggaaggctggggaataaatgcccccaggagcagccctcaaccaatgattattgggagttggtggataaatgcccaagcttccttgccccttagacagaataattacgaagtgattgttctacactgtgagaaggtgataagcagtctgtactagtccgttctcatactataaagaactacctgagactgggtaatttataaagaaaaaaaggtttaattcactcacagttccacaggcttaacgggaagcatgactgggaggcttcaggaaacttacaatcatggcaaaaggtgaaggggaagcaaggcatatcttttcatggtgacaggagagcaaaaaattaagggggaaagtgccacacacttttaaaccatcagatattatgagaactcactcactgtcatgagaacagcaatggggaaatcctcccccatgatataatcacctcccatcaggcccctcctccaattcgacatcagatttgggtagggacacaaatccaaaccatatcgcagtccctgacagccagcactggcctggtacgcacaactaggtcttgatgttttcctgttgaacataaacagtctcacagagcactactgccagacaaaatcactctgtgatcttgacgaagtgagaaaaaaaataccacttcataaccttgtctaggcatagaaaaaacaagatcactgtgcaaatgaaaaaagtaccaaacacggagttcaacttccagcatgacagcttgaggaactctgctgatgcactcccaagtgaaagtggtaaatattatttttaaaacaacaacttaaagcccctggaaatggtcctaagggaaaacagcaaatgaagaaacgtctttctaagagaacctacaaaaattcaataagaaaagcaagtctgtggtatttgaatcactacagcttcttccttttcccctcccagatcagtaaggcagagattctacttcagactgctgcagacaagagcatagggctccctctcccctctggctcccagccagaggactttcttcccaagaggagcagcacttcagcatcattcatactgacaccagctacttgtttctgaggctaagtatcaggtgagtacagctgagtgatggtggctcatttaatctgccgactctgtcccccagttatttaatggaggctctaccttagatgcaacacactgaggaaaccgcggctcaagttttccttgcctcgctcatgaggtggtggttacatgctgaagaggcaagccgagagcaccttaggctgctgcaccccactctgccaaggcctcagcccatagaaaggggttgccattcaggcagaagcttgccaccgtccccaccttgtctctagagctcttgctcaaagattttgccttggaggaggaacaggctacaaaacaggtagctcctaatctcttcccaaagggattgacttcatttgcaacagagtgtaaagttcaaagctaagagtgctctcaagaacagtggacgttgtcatacaaggcagttgagatttgtggatctaatgaagataaagcatggcctgtaagctggatagttttcaggagaaaaccaggaaataagatggctggtaagagcactcctggtatcagaacaaatatcagacgtggacctcaaaaactattccttcaaataaaccacaatttaattgaattagtttgtagaacaatttatgtcctagagcattgctgaaaacaatagaatgatcagcaggcaattagtggagtttaatagttgggcatggtaagggaaagacagagagccctactaacaccactgccatcctagagtgacggtgtacacacccaaagtcatgtcttcctgaagagcaacatcagaggcttaagactatgaggagaaggaataagcttcattaaaataatccagccaatcactaaaaaaaatataccagcaaataacaagtcccagaggccagggttgggggcagttgctacaacatattatcaaaaattttgtggccaagcataatgcttcacacctgtaatcccagcactttgagaggccaaggtggaagaatcacttgagcccaggagatcaagaacagcctgggcaatacagagagaccccccatctctacaaaagtaataaaaaaaaattagccaggtggaatggtgcacgctgatagtcccagctactcaggaggatgaggtggaaggatcacttgaacctaggaggtcgaggctgcagtgagccatgattgcaccactgcactccagcctgggtgacagagtgggaccatgtctcagaaatgatttcaatttccagcaaaaagtttatgaggcatgtgatatggtttgtctatgtctccacccaaaatctcatcttgaattgtaatccccttaatccccataatccccatgtgtcaaggatgggaccaggtggaggtaattggatcatgggggcggtttcccccatgctgtcctcgtgatagtgagtgagtcccacatgatctgatggttttataagcgtctagcatttctcctgcttgcacttctccttcctgctgccttgtgaagaaggtgccttgcttccccttcaccttctgccatgattgtatgtttcctgaggcctccccagccatgctgaactgtgagtcaattaaacctctttcctttataaattacccactctcggctatttccttataacaatgtgagaacagacaaatacagacctgcaaagaaacaggaaagtatgccccatacagcagaaaaaaagcagacaacaccaactgcctgtgagagcaaccacatgatggatttaacagagaaagacttcaaaatacccattataaatatgtttgcaggccaggtgtggtggctcatacctgtaatcccagcactttggaaagctgaagcgggaggattgcctgaggccaggagtttgagaccagcctggtcagcatagcaagacctccatctctacagagaaaaaaaataatatgtttactgaactaaaagaaagcatgattcagaaaataaaggtatgataacaatgttgcatccagtagaaaatatcattaaagagatagaaattattttaaaagaaccaaatggaaattctgaatctgaaaagtacaataactgacatgaaaaaatcactagcaggttcaatagcacatttaaactggcagaagaaagaattagcagatttgaaacaggattgatagtgattatgcaagatgaagactagagagaagaaagagtgaagaaaaataaatagagcttcagacaaatgtaggacaccatcagccacacaaacctaagtgggatctactagaagaaaggaagagatagagaggagatgaaaggaagagatagagaggagcagaaaaaatagtcaaagaaataatggcagaaaatttcccaaatttattttaaaaacaataacctacacactcaggaagctcagtgaattctaagaaggatatatgtaaagaatccacaaacagattacatcatagtaaaaccggctaagatcaaggagaaaatcttgaaagtggcaagagaaaaatgtctcatcacttaccccagtaagattggtagttgacttctcagcagaaacaatgaaggccaggaggcagtaagattaaatactcaaaatgcttaaagaaaaaactatcaaccaagaatcctacatccagcaaagctacctttcagaaatgaaggcaaagacattcccagttaaataaaaatgggaggatttgttgttagtagatccacctcacaagaaataatgaagttcttcaggttgaaagcaagtgcttcagatgttaattgcaacctatgagaacaagccaaggcccactttatccactgcctctttcccttccagcctcacaagtgtcagaaagtctcagccacaagtctgacataccaggataaaaaccccactttatcaattacagactgaatatttttgggaagtaacagccactctgggtatgacagttaatactgagtgtcaacttgattagatagaaggatacaaaatattgatcctaggtgttctctgagggtgttgccaaaagagattaacatttgagtcagtgggctgcacagggcaaatccacccttaatctggtgggcacaatctaatcagctgccagtgaatatgaagcaggcagaaaaatgtgaaaaggagagactggcctagcctcccagcctacctctttctcccatgctggacacttcctgcccttgaacatcggactcccaagttcttcagttttgagactcagaccggatctctttgctcctcaagcttgcagacagcctactgtaggacctcgtgatcatgtaagttaatgcttaattaactccatatatatatacatggaggatatatatatatatatggaggatatatatatatatatatatatggaggatatatatatatatggaggatatatatatggaggatatatatatatggaggatatatatatatggaggatatatatatatggaggatatatatatatggaggatatatatatatggaggatatatatatatcctattagttctgtatatatatatatatattctgtatatatatatataagttctgtatatatatacatatatatatcctacatatacatatatatatcctacatatgcatatatatatctatatctcctacatatacatatatatatatatatctatatctatatcctatttgttctgtccctctagggaaccctaatgcactggatctcaaagtttctatggtgagaccaaatgtttaaagatgtctgatgtccccaagaccaggagaacaagggagtaaggaaagagagtgctggaactttatgacttcaggcagtcactgtctctctctgggcctcaacttcccctttgaaaaatgagaatgtttgccctctctaagaataccagacccaaagtgctcaggagcatttctcaagattattggaagtgtcaaaatgagaatcagatcaagttaggaaacattttaaagtttattgttatacagtaagagaaagtacagctcatgacccaggagacttcaaacaaagtggtagaaagctcaccttatggcagtcatagcacactttataaagcataaaggagaatattttgatttttttttgtggttggctgttttacgttatcattctttttaaggtaaacagagctgtttaaactgatttgcctatagctgattggtttaatttcactgaatcatgctgacaaagatgtaaaggttatgtttgatatttatgattagagacagtgttttggggaaattgggaagaattaaattttggttacctggttatgagtggttggccttcgggtacacctaaagtgtggcttcatttttatctttaacagaagataactgagctctcattatgtgctagggcactgtttaaattctgaatcctgccctctggtaggaagacagagattaaacaagagagccaataaccaaacaaaaaagtagagagactgcggggttagggattttagctcaggtgcttagagagggcatttgagcagaatcatgaatgcagtaaaggaggcagccatgcaaaaacctgtaggaagagcattccaggcagagagaacagccagtgcaaaggccccaaggtgggaaggagcttggtgtgttctcaagacccatgtgctcaggacccagggggcagaggaggaagcagggggaaatgaggctaggaaaggaggcagacgaagatggcagaatagaaagctccgctgatcgtcctcctgccactctgtgcaaggacaccaagttaacaactacctacacagaaaaaaacaccttcttaaaaaccaaaaatcaggtgagcacttacagtacctggttttaatttcatatcactgaaagaggcactgaagagatatagaaaacaatcctgaatcaccaatgctaccccttccccaccctggcagccatggcatggtgtggagagtgtttctgggcactggggaagagagaacacagttcttttgcttcacaattcaattgtgaagcattgcactcagcaatgtcctgttacagcagaaaggaaaaccagatcaaactcagttgatgcccactcacagagggagcatttaaaccagccctagccagaggggaatcactgatcccagcagtctgaacttgagtacctgcaaacctcaccatgaagggccaaagtgctgtcagtctctaagtaaacttgaaaggcagcctaggccataaggactgcaacttttaggtaagtcctagggctgaactaggcccagacacagtggattgggggtggcggggcggggaacacaacatgctgagacactagctaggacagccaagggaatgctggcatcacttttcccctaaccccaggatgcacagcttgtggctctaaaagagagcccttccttctgcttgaggagaggagagggaagagttgggaggactttgtcttgcatcttggataccaactcagccacagcaagatagggctccagtcagagtcaacaggcccctgttccagccctagttcccaaatgacatttctagacaaactgtgggccagaagggaacccactgccttgaaggaaaggaccccatcctgccagcattcatcacccgctaactgaagagcccttgggccctgaataaccaacagcaatgcacaggcactacattgagggccatcatgagcctctgagacttgctggcttcaggtaccaacaccaccacgggggctagagcaccaagcaggttcttgaggttccagattccaggacttgacagcatttctggacctgccccaggccagaggggagcccactgccctgaaggatgagtcccagaccaggcagcattcaccacaagctaacttaagagaccttgggccttaacggaacattgatggtagtctgtcagtgctccttgtggccaggggtggcagtggctgtggagtgaggctcctttgcctttggaaaggggagggaaaagcaggaaggactaggtcttatggtttcagtgccagctcagctgcaatacaatagaacaccaggtagacttagaaggtttttgactctagtccctgactcctggatgatacttctagacccacctggggcctgggggaactcactgacctggagggaaggacacaggcctggctggctttgccacctgctcattgtagagcccagggtcttaagcaaacatagagacagtagccagggagtggttacagcaggccttgggtgagacccagtgctgtgctggcttcaggtctgacccagcacagtcatagtggtggtgaccacaggggtgttaatacctatgtcactccacccccagctttagttggctcagaacagagagagcgattctgtatgttcgggagaaaataagagaacaagaggccaggtgcggtggctcaagcctgtaatcccagtactttgggaggtcgaggcaggtgaatcacaaggtcaggagaccgagaccatcctggctaaacacagtgaaaccccatctctactaaaaatacaaaaaattagctgggcgtggtggcatgcacctgtagtcccagctactcgggaggctgaggcagtagaatcgcttgtacttacagtggaacgttccaaatgaacaacaacacattgaaatacatttaaaaatgagggctcttggtaaaatcccttttggctaaggacgggtttggcactatggaatgttaagtgctattctctttggattaatcggtcttacactttttgctgacggctatgggtgacaggattaggcatgtgcaggaccgtgggagatggggagctttttcctccccagaaggggaatcctgacagctgatggaactgctggaaaagatcccttcactactggcaagtggtcccctgaacttttcattttcagtgtcactgcaatgaatgagtgggtccttctctggcctctgtgagctcttcaccttccccaccctgccacaggcaatgcttttctctctctcctttccctttcttatcttttctattactcagggtgaccatcttgcccagggacgtgttgaaattcctagtcagaagctggattaaagatgacgggagccatctaaggacaaatttaagccttgccagtttaatattgggtgctaagcagagtagctgatgtctatgtttcgtcacacatattttactctggcccaaacagaaaaagataattttcctttgtgttgcggcttggccccccaggtctatggtgcagcgaggtgggtcactagggccacttagggaaacggaacacagaagcctggcatgctggcaaacaggtaacaatttcttaccagtcagactcctggcctctctctctctctctctgtgcaaacaggttgaataaatggtaaaaatcactgttactctcctgtaaagtttaaattaatcagaaaaagcacttgtaaggctagtcttaagctgtaccaaatttggtatgctttgtgtgtctttccgtattttctgtcattaatgaggggtaccttaggatagaatacaggcttaggacacctgtaagcccgctgttcaagacagccaagcaaactgatcacttataagctttgctgcaggtccctggaaaaaacaaaaaacaaaacaaaacaaaaactggataaggtttccctcttgtcttgtatgtccttgggagcttgaccttgtaaccatgtggccatgctttctcttcacaatggcagcctgggttcagggttcaattcctggcttggaaaatgagtcctttaacttctgtctatggatttatatgtattatgtgtttgatgtttatatataaaagagctttcactaattggtttaaaaataataaaagcttaaataacatattttgtcagaaaagtaaaaagtgtaatgccttttagttcatgtgtcttaagtaatttttgggaaataaagagagttttaaaaattattggtaaaatgaaaatgtcaaataaggcaaacgtcgagctgtaaccaatccagccattctctatctcacttctgatttctgtatgtagtttcccttttttgtctataactctcccaccacatggctgcactggagtctctgtgaatctgctgtcattctgggggctgcccgatttgcaaatcgtccattgctcaattaaactcctttaaatttaatttggctgaagtttttcttttatcacatgagaacaggacttataatgagaaaaaaaatgaggtggaatgatggcatcctaggattgctggctttagagttgctttcaatcatattctattgctccacggttttgaatttgcttaaagttaccttctcaagtacaggttgcaaactggaagctgcatcctatatctggtctgcagatctgtttcggatgaccagtgtaattttaaataaaacatatttgaatcgattgctcagatctaaggatcagaaggtttcatgtaaacacttatttctggccaatctttacaaactggaaaatctgccagatctggaccccaaagtcctgaccagaaaaattaggctgaagcagagtagtggccattccctttgggggagacatatcctttcccagtttaccagtccccactctgcttgttttcttcatttatgttaccttcccggccctgttagcagctaggttttcgacccttactatttttttaaaaattataggaaatgtccaaaatatataaaacaaacataagatgaacactcatatagccaccacccacattcaacaattattaatatccagtcttgtttcatcagtagccttgctgatttctccaacatccctgcacccaacctgggattatttggaagcacatcgagacatcacataatttcatcattaaccatttcagggcatgtttaaatgatacaccctttttatacagacagccacagttatcactaccatagcgaaaacatggaaaagcctttacaaatatccactctgctcactttaaaaaattcctctccatattattcacttcatttgattccttttctctgtcaagaaaggacaaacagtaattgttgatctgggaaaatgggggcgagcatgcatataaacatgaatggtactccccacactctagaaaacaatgcgtgaaatgatttttttcataaggcattcattcctattttttctgattttttgaaatatgcctgataaacttttaccactaaacctactccaaatacatgagtcatgctattactgtcatgattccataggtgagatgatatggttgggatatttgtctctgcccaaatctcatgttgaaatgtaatccttattttccccaatgttggaggtgaggcctgttgggacgtgtttgggtcatgggggtggaaacctcatggcttgatgctgtccttgcaatagtgagcgagttatcacaagatctggttgtttaaaagtgtgtggcacctcccacacccactctctcgctcctgctctcaccatgtgagatgcctgctcccagtctgtcttccaccatgactgtaagcttcctgaggtcctcaccagaagcagatgccagcatcacacttcctgttaagcctgcagaactgtgagccaactaaacctcttttctttataaattactcagcctcaggcatttccttatagcaaaacaagaatggcctaacacatgagacaacagagatatagtaggttaagcgactcattcaaggtaacaaagacagcgtagagctgcagcaagaacccagaccaccttatttttaatcagatctctttctgttataccacataggaaaggtggaacaacaggttataataatatgatgataggagataatatagaataatagtagaaaacatttctgtgtgcttactctggctgggcattgtggaaggccacttacatatgttatttatccctctcatcaattctgtgatataatattatcatcttatagagaataataatgatactacagagcttaagtaaaatgcccagggggaaacagctgggaagtggtgcatctgggattggaagccagattgccctaactgtggcatcccagtgcaccaccgctgaattaaacttgacaaagcatgggctctggaggcagacaaatttggcttcagatcctgttcctctgattagctttgcaccatggataagtttcctcttctttcaatgaagatgctagaacctcactattaggattcatttgagcatcaaacaaaatcatccaaggacattattttattgcttgtcacatagtaaaggcatacaagacgttagctgctaataaaaagggaatgaaagttttaaagggtactgtctccagtaatgttctccatcagaaaaaattgtaacttgttctccacccagccccttgaactagtcccattgtatgctacctaaacaatgtgttgttcaaggtcagtaaatgacatcctaactataattctacaaatttgaatttcttaaggtccaagaactctgctttgaagttcaggatctaggttaccagagctagacaacatcttgacctataattctaacaggtacttatcagatacatgaaaacaaatgccaactgagtataggagatctcattttctacataaaggaaacatatatggctaaaaatgtcttttgatggtgtaaaaattttatgaatctgataaccacggggagggataatggaagtatgacttcaatctcccctcctccccttttacctttctttgcctatttctgagtatctgtaggctaccaaatgtttcagtctgaatgtagaaaaaacaaaataatgagcaggaatagaccgactggcacaaaatgtaccaaatggaaacaatttccagacggaatgtacactgacatgcgcgacttactgtaaataattatacaaagcacaatacaatgagaacaagagcaaaaaaaaaaaaaaaaaaaaaaaaaggaaaatctcaatcggagaagaaaaaagaatccacttggccaagaggcatgcattaatgcatagtgaattcatggactttccttattcccaccaaggcttgtggcttcaggggtatgaataaacctccttctccttgcaaaaccctcacaccaaatgcaattgcgtggctgaagcttgacacccacaattgtgaagagagaagtggggaatgaaaagcagcagacagcctgacagaaagttcatgctcacccaagaaaatggaattttccttcaggctgaaaacataatcattatgaaactggccatcaaataattttcagagaaaatactgttgtaaccatcactccttatctgcaggcattgcaatcacttcacaggatgaccacaatgttcatgatcactttttaaaaactttttggtatattttttcttttcttttgttgtggtaaaccatataaaaatttgccattttagccattaaataagtgtataatttcatggcattatttacacttacacttttacaagaaaattactttaaagaagtcttccatagcaagaaaaaacttaatgaatttttaagagtgggcatggcttccttcccgataccattttggttttgctgttttccaccctggcagtaacttgaaacacactattctctcattagggactcacaccaccccatcctgcacatgtacctggtatcaatgggggcagagaggagatgagtatggggtgttgggggtgggggtggaagagaatgtctgggtcggtgtaagcctgccatgggcacatgggaaaattctgtgacatgcacagcccccagatggtgactcaagattactgcatgagacgagagtccgtgacattcggtttgaatggcatttcttaacaatttttattgagaacttactgaccccatgtgacacacaaaacaaatgtacatacccttcacatatttatagaaacatttttacaagtgccctaaaaatgggtcaatgatgtacttttctttaaaacgtttaatagacatttgatgaactacttttgatggggtgctatgcaaaatatgaatctggctcaaagacactctggcaaaaagtggcacagaggctatcccttagacattggggaatgtgaaagaaggcacgataacaaaagggaatgggccaaattcagcctggccagcgggtggcataggtggaagaagcatgagtggaaggggcaaggacggaggaggaaagggtggcatggggaaacacaggctgctggaatggctgtggtcccagaagtaatcatctctcatcccgctgatgaacaagggtgccgttatggcctcagctgcggttaccatgacaggctggcccactgccatgaagggcagcatgtttcttgccattaatgccctctgatgtctcctccatttggctcttctattctcaaaccaaatcttcaatcagaggaaaaaagaaacaggtttagtatactgagcatttaatttcatcatggaaaaaaacacaacaagcaactctctatgtccttaaccttttcgggtgtatcaagacaagctacttccttactactaaaatatcttagaaaggtgaccaccacacctttcccctagtgagctccaagtatgtgctacgtacgctctggcctggcttatttctttgtctctctccttttatctgtaatattactttttccactcttgggtgcaggtgtagctgatgagtgggactcgatccctgctggtattgctatgtgtggcatgtctgcttgcagatacttgaccatcagctacccagctgcccaccaactcctacttactaggccactgtcaccctggtcgtgggggaagctgagcttggaaaaaaaggcgggggtgccttttaaagtcataccaagaagatgaggcccccgttttgaaaagcccatcttcagtgtaaagtaaaaaatcggtaagagtacattgtattttaaaacaagttttctttccttcaagaaattctaaggggtcattcatcttctgaaactccttgagaattaaaaagatggtatattgcaaggcaagtctcgttatagggggcccagggagtttgtggattgtcttgctgggaaatgagggtatctgaagccctggacactcttcacacttcagcttgaagctttgtggaaggaggacacaaatgttgtccaaattcacaaaaattctcaaaaagctttgcccagttgagagtttgggagaaaggaagcattgctaattctgcacgctccaactcatccctccctccaaatcttcctgggctaaggacaaggtcagctcactttgttctccctatagtcctgggatatgggacagagacttggttgcccagttccatgggacgccttcagccatctagcctcactactcgagcagaagatcccaatctcatcagcattcccaaagcgggagtgtccaaataggcaactctgaacacgttcagtagtaatgtggaggaggtatcaaaaaacactactccccaaacacctgccaattgttaaaagaccaaaaaataaaacctgtcaattaaacaacactatcccccaagcttctagttaatgacatttccattgtattttgatccttctggaagttcccaaactgcaaattttatgggacaaagggactcttctccctgtttgatgccccatttccttctcccatcttactatttggagtccttctccctcatgaatacatagtctaaattttaagcctaccgtaatagtgcttgtttagagacaattccaatgtacctgtggtcaaaggttcataaacataagcaatgccaaaagtgggccaaatgtgctatgggacaacattaggtccctagtctcagtatcggtttcataaaccagcccttactatctttacaaaacagaggggggaaacatctattaaaaatttttggagatattcatgctgaaatgtttggcaatagatgagaacatcatgcctttttccttatttgctgagtgagagtggtccttttgccttcagaactgcattgagtgaatgctatgtaaacccagggaggggaaaggcaattcaccaaaacgtcaatatttcatctcccccaaattggcattgcctgcctgagaaaatggagggcaacaggatgccaacactcagtgccccgttttgtcaggcagcttttctgcatgccaccattgacagaaccgcagcatagttccctcactgcactcacacacatgagctctgcagaaaagctgttaaggtcatcccgatttttctttcttttcttccttttttgcaaatactcctttggatccactgacctacaaatttattatcacagcctgagcaaataaataaaaaggtatttcaaattaccacaggtaagagtctagcctgacctgacagccatcccccactatcaacacattccacaaaacacatctcttcctgttagtacaacaaactggaagaaacaaaaaatctcttaaatgctagaaattgatcaagaaaatattcactgatgcatttggtagcttcaaaagttgaatgggggcagcttccccaagccatgagtgtgactgtatacaattcttgcctaacacttccatccttaggttggtggaaatttatgaaaaattgatcttgtagtttgttttggtttctagataaacttgcaaaggttgcaagccttttcgctatctctaccataatgcaaaaccaactatgtcagcaatgttttcagcctgccatatcaaagtattccagaaaattaaaatttagagctgccactctctacaaggcttcaccaaatacttaaaaacaatagtaggagggccaggcacttgaactttatgctatcccccgccatcagtctcagcttaaggaaacatacgttctggttgggaattattcctttaccccaatgcctaaacatttataaattcttaaccaaagagtttatgcttggttttaaatatattaaatagtttagtttaatggagctctttggagcattagttcgaataatccccatgtcagaaaaccccaggatgcctccacatggaagtgctacctaaaggataccagtgctaggaattcaatcttatatattatgctatatttaatttatactgttatatattatatatatttgtaatttggaatacatatatttatatatttgtaatttattcaagtgtataatatattttatacacaaggaataaaggaaacagttcagtactcatttttttttccgtggattgtcatgttccctctggtaatgggaaatttccacaagctgagctttccttaccgcattttccagccacaaagatcccaaagttcagacctcattgcctatacatgaaaaaggccacaaaaacaccaagatggcaatgtctgggtcaaagtgtgtccaagccctgaagcgggttttagaatggctcccctgcccgattgctttttcggtttactgacctgcactgcgagttcagtcacattcatgcttcttgccagcctccttctatggaagaaaccacacgtgttcagcatttggagttgtgggtgtcgtttcattcttgtgtttaatttttttattctaccaactccccacacccagtaggctgttctgtaacacccagctgagcctcacattaggaacatttctctcatgccacaaataaaggagatgccaaaaaaaaaaaaatcagggcggtggctcacgcctgtaatgccagcactttgggaggccgaggcaggaggatcacttgaggtcaggagttcgagaccagcctggccaatatggtgaaaccccgtctctactaaaaattcaataattagccgggcgtggtggctggcgcctgtaatcccagctacttgggacgctgaggtaggataatctcttgaacctgggaggcagaggttgcagtgagccgagatggcaccattgcactccagcctgggtgtcccagcgagactccttctccaaaaaataaaaaaataacccccccataacaaaaaaaatcgttaatcaatataaatgacattctaacttactatttgaaacttagaaaaattaacaccaaaggaaacccagacgaacgacggacttctcagaattttaaataaggtcagaatgcgaccctgcacttgctgtacagaaccttaatctcctcatctttatttctgcctcgcctgggataggagttatttatcataactgacctcagcccaaagttgcccaacttggttcatttaaattctgcatgatgcctaataggcatagccccactacagaacccactaggtgccaggggtctgcggggaggggacggcagcaacaccaggccccagatgggttttggttcaggaggggagagggtaggagagggactgcgggaaagccaaacgccgcctccctgcaaaccgcgcgccaaccagagcaatgggcttaccgcaggaactcactggggaactgctcgcgttggaaaatgcactccagctcctgcagctgcaatggggtgaaggcgtggacgttgggctgctgcgcgttgccaggctccagccccccgacggcgccctgtgggcgcgaatactgctgcccaggttccttctcgctctggtcgctgtcctcaacgttgccatcgctgccgctggtgccctcgaggtttccttcccataggtggccaggaactccggcgccgccgccatctttttcttctccgccgccatctttttcttctccgccttgggctcctgccgactttaacttttctcctgctgctgtgccttgctcaggctcaggctgtgcatcctcttcctcctctttgacctcttcagtaagcgacagcaccatagcattcatatctggaaaagtagaaaccccaagagaaagatcaaggcattggtcctgagggtgttggaaggaggtggtgaggggctacactctgagagcagtggtagtgcaggggtatcatccagtctactcgcctctcccagagaaccttggtttcctgagttcgcaaaagcatgtgtcccatcaaggtactgaccctgtagttctttctcgtcgtcgactgcagggctgagcaagctggtcatatactggctacactggtccggaggctccataccctgagtggtgtggatggagctgtgcacttctgcagattctgagctggggccaccacgctctcctaggcagtgctagaactgtgagtcgccgcctgcaacgttcttctggtgtctagactcagcaacagtgtatccacttagagacctcctctcttgcttttctgcttcccgctatttgctgtgggttgggcctgctgaggtgcgcatgcgtcaggggcttggccttgcccggatgagggagagcacgcgttggtggtgtggggggggaggggtaagtggtgtagtagggtgtgggggaggggggagtagggcgtgggagggggagtaggatggggtgcgtgcttgcatgcgttgtcctgtagacaggcatgcgtgagtgtggaacttgggggaagctgctgtgctgaattgtgcaagcccattttatggcgataagggagattttgcactagccccatgcttcctaggtctccaggagcaggagcttgggcctggatttgcaaagcttgtgggctgcgcaaatgcactatgtaaaaatgcagcacactccttgagaaagtccactattaattcttagtaatgaatccacatcaaagtgcaagggtggaaacatgcacaatgatgcttagagcatccgagattgcttttcttttctttctttctttctttcttttcttttttttttgagacagtctcgctctgtctctggaatgcagtggcactatctgggctcactacaacctccatcttctgggtacctagattcagtaacagtgtatccacttagagacctcctctcttgcctttcctcttcccactatttgctgtgggttgggcctgctgaggtgcgcatgcctcaggggcttggccttgccttgggcacgggagagcacgtgttggagtgggggcagtaggacggggtggggggagtagggcgggggagggagtagggcgggggggcgtagggtggagggggggactagggcgggggggccggggagtaggatggggtgggtgtttgcatgtattgtgcaggtactcaggagtgcctcagcctcccgagtacctggaactacaggtgcgcaccagcacacctgggtaattattgtatttttagtagagacagggtttcaccatgtttgctgggctggtctggaactgctggccccaagtgatccacccacctcggcctcccaaagtgccgggattacaggcgtgagccaccgttcccagctgcagccaagatttctaaaattgcagggcatccttcctttgcctttggttgtgactgtggatagcgcagcttctgctatgtctctggctacagacccattacaaatgcgcacttaccttctgtgctgagctggtgctgtggacctgcagtgatttcccttctttcctgctgctgcatagccctcttttcctctactcctgcccttttctacagatatctttctgagctcttgtttaggaataaatacattttatttattgtcaaataatcacagccaggacagattgagtgctctaagattcttcctttaagaagtgttttgtagatacttcaggacttgttaatgtcctgaatatagagagtaggttttaaccatagaacctatcctccatcgtttgagtgactcattctatttttgcttgcacaatgacccttttcatcaaccttattttatataagaaattaaactagtttgtgggcccctacatgtactgtgggttccagtcaccccaacgactgatcctaatggatgagtgcacgcatcatacctcatgttcccagaggatgggtaagaaaacagctggaaaatatttgaccaattcacgttcaaagagatgggaagggatgacgatctaacagcctctttctgattttaactaagatgtctcctcgtcaggctggctcttcctggagctaaactgctggaatctgaaattttgctttgcttcctgttgctagctggctaatctcacttgatcactctccgtttgtgttagttttgtcatctgtaaaatgggaataacaatgataactatctcatggggttttcgaatagatggagatgattaaacatgctgcctcacatttcctgcttctgtcagtttgtatgtgtttatttacaagggtccttgaaaggagagagatgatggctattctctggcagtgggcaacaggggtaagatgttttattgtgaaaataatggttctataagtctttttgtacctatatgtacttcactcagtaaacctttgttggctgctgtgttgacagggccctgtggcaagaaatgtggggattgccacaatgtctgatcaatgcctgaccattgagatgtaggttctcatagtgtagtgggattgataaggaatcagagagactgatggggttcaggaggatatttattatttaggtgcaccggcccagtaagattaagatccaaagaactgagccctgaacaaagagttaagttactttttaagcatttcgtggggcagggggaagcatattgcagaagtgagaaacagagacagttattcaattaattgagacatgcattacatcatttcttagttttcaaggaaaaacatgttttatgacttgagtttatctgtctagtgaacttgcagctgcacagctagggaaacagggtcttcacaatgcctgggaaaggaggagagataaggctcactagccacagaaaaacaggcagttaatttttaaaggactccaactctttctctttctcaggggaattgggttttcttacatacgactgagtttctgcttacatattctttaatttcttttaattcctatttccattcccccctttggtgctttttataacaaaggtgttaatagaaagcaccactacttgccacctcttcgcggagctgagctgcttctactggcagtggctgatatttggttaatgccatcaactgtgcggtagtgtgtcgggttactattgcctctgtagttgactgaatactcctagtaagcaggggtaaaaggcaagggaggatgaggcagttgccaagaataagcaagaacctaccaatgagggttttgaatcctccaaaggctgagaaccatcctccaaacaaggaatccagggaccacccggatcaagtctgaactagaacatgggccaactcgcccattctagcagtgatttccataatagcttggccattatcatcgatttctaggcaacagttggttaaattaaattttctacatactcctccttctgaggctaagaggtaatccaaagctcatctattttgatgtatagcatttcttatttgtgttgcttgtattgccaataaacctagtgcccttggtgtttcattggttataatttcaaggactacctacaaccttatgatgcagttgagcatatagattggggtgcaatatccccatgaaccgtcttgcacccagatagctggcttataatatttaatgattctttcaggagaccattcattatcttttcagtctcctatgtccacatctttttgacatttgtgtctatttttgtgattatgcttcttctagttcttcttttattttcatcataaactggatatcctaagagttcctcttgctttagaggaattagaaagaaggatggcttgattgttcctaacacacatgcccctgtccatttagccggcagttgctgatgtacccatgctccacagatccattataggccagaggatgccttccaagcatttggagcctctagctgattccaagtgtggcttagagtagagaatcaagagaaagggtttggacctggtaagtaggagtcattctgggcatttctccgtagagttttgtttttagtctcatcataatgctgttgccctaggcaggttgtttctcctgctgcctctgtgaaagcctttccccatcgggtgatacagtactttttaattacggaggtttttaacaaccaaacactggctgaggctgttggttcactggcagggttaggcaaagtgaagttaccttgtggcattaattcctttgcctcccatggccactggtcacccatattagttcctccacatacatagcatgaggaaattcctaagctgccagttatgttttcagctagttgagcaaatatgtttttgggtgatgggggaagctcaggcactggctgatcaaaatgcttatagaatgacttatggacccagaattgggggattggacacatttgagtccttctagtctttttgacaatcagtagtggaactccaaggcctgcttcttgtctatcaactcataatagtgctgcctgccctgtagaccaaaaaggtagctctggctttaagatagtaaaatttaaagaattgcatgtccttgtcttacaatttagtttgactgacatactacttagcagagcagtccatcctgaatataagtgttggagctgtgttagcatagaccactgaatgttacggtccgggcatccgatttgtggttctccatacagatgtttagggctgttcctgctcagcctctcttgtgttaaaccattgcaggctgcttctgttttttttaagattatgaacatatgcggcatggcaggcatcaaagtacaaggaactacgccttttataggagggaggggcttctttggttcgagctataagctctccttctttttctccctctgatttaatatgtacctcaaaccagaattcataaggtaagagtttagggtcataacctacatgtagctgattatttcctgggtcacagaatgaataggtggtctggttgtatgtgcagattcctaacttggttcctgtacattcatagtaggtatggtacagtagagttttaactatggtgtttcttacccaggtagtgtgtacacagtatgggcatctttctagagatttctccttttttagtataggcagaaatggtaagaacattagtgtatataatagaaacatgcttacactacacatgggcatggcaaaccttcctctgggcatagacatttgcagcatttgcagtaataacataacataataaccagtattgacagaattatagctaggcttataaattgtatccacatttgcttatccggagatggtccttttagcttcggctgtgcatagactagtcagcttccgggctgtgactagagcagagcttgcaggattctcaagcttcacctgtgcgtagactgaccagcctccggtgtggtcagagcagggcagttgtccttcttaccggtagttgggttttgccataggactgttctggtggggcaatctgggtcttgttggctagtccactggtcgtcatggggagtcactgctgccgctggttttagccagctatggtgaatccaaggtgtgacacctgcaactttaacagcagtgggagtagacatgatcacaatatggagcccatcctataagggccccagggttgttggattccacctttttttttttttttttgagatggagtctcgctctgttgcccaggctggagtgcagtggcgcaatctcggctcactgcaagctgtgcctcccgggttcatgccattctcctgcctcagcctcccaagtagctgggactacaggtacccaccaccatgcctggctaattttttgttttcgtatttttagtagagacggggtttcaccgtgttagccaggatggtctcattctcctgatctcgtgatctcccccccgccggcctcccagagtgctgggattacaggtgtgagccaccaggcccagcctggattccacattttaacccagacagaatccccggtttatgtggatgcactgggtctgttagacttaaaggtatcctttcacttacccagccttgcacctcctgcattgccactcctaaagcctgcatctgtcttctaagggttagctctcctaactcctttaactaccctctaatttgattaatgattgggggtggccttccaaataatatttcatagggtgaatacccaatttgttctgtaagtgtacacctgacctggaggaggaccatgggcaagacctgatcccatcgtaagtgagtttcctggcaaaacatttttagtagctgtttgagtgtctggttcatccattccgccttccctgaactctgtggtcagtaggctgtgtgcagtttccatttgatctttaaaagctgagtcagctgtagtactacttctgccacaaatgcaggaccattgtctgatcctagggttaaaggcaatccaaaccttggtatgatgtcttttagtagcacctttgtcacctctcgtgccttttcagtcctggtggggaaggcctcaacccaccctgagaaggtgcaaagaaacactagcatataccggtaacctcctgctcaaggcaactcggtaaagtctacaagcaggttctcacaaggcacagctcccatttcctgaattcctgggggtcgaataggtccttgttttggcttattccagacacaggatagacattattcgcaaacagcatgggtgatggcagagagccgtggcacatagaagtgttgacctatcaaagtctctagtttccagtgtgtgttctttgatggatctgcttcacaaaccttgaggctattgtctctgggacgtctagtctcccatcagagaacagccaccatccacctttaatatatttccctgtttccagaacaaaacaagctttttcactcgaagagtaagggggtacctccagcaaagggggctctataaggagaggcattgctagagttctttcttcaggtgaagccttgctcattgctgcctgccgagcctcttggtctgcctttctgttgccctgcacctcatagcttttcctgatttggtgtcctttgcaatgaatgacagccaccttctccggagcccatacggcttccaataattgcaaaatttcctccttattttttatttcttttccttcagtagtcaaaagtcctctctctttgtgtattcccccatgggcacgcagggttgcaaaagcatattttgagtcagtacatatgtttactttcttccccttggccaataacagtgctctggttaatgctattaattcagccttcttagcggaagtcccagaaggtaaggcttgagcctcaaccactgagtgttgggtcactactgcatatcctgcatatctcaccccatctgttatgaaactgctaccatcagtgaagtatataacatctgggctctccaagggggaatctctgaggtcttcctggctcgagaacactttgtccaccatatttatgcaacagtggggaaggtcctgccaggagtgaggcaacccagcatccttccaatcgggttcctccacaggcagcagggtagctgggttcaaggtatttacattctctagtgttatctggggattttcacatagaagcccttgatactttagcattctagagttggacagccaaccatatcctctttgctccattaaggtgactacggcgtgtggcactgaactattaacttctgacctagggctagcttgttggcatcttctataaggattgcggtagctgccaatgccctgaggcagtggggccaacctaaagccaccaagtccagtcttttggataagtatgctaccggccgatgccaagagcccaagaactgagttaagactccaactgccattccttgacattcatccacatacaaaaaaagggcttttttacatttggcaaccctagtgccggggcctggatgagagcttcctttatatccttgaaggccttttcctgtttcttttgccataggaggggctctctttcctttccttttatagcctcatacaagggccttgctgtaagggagaagtttggaatacagattcggcagaatcctgccacgcctagaaattccctggccttgtaactggggtgggcagtgcacatacagcctccttgcgtgcacttaagcctgcgctggccttgggataccatgaatcctagatatccaacctcctgaaaacagacttttgccttgtccttggacactttataaccggcttcacacagcacgtgaagaagcctctctgttccttggagtcattcctccctcgtgggggcggcaaataggaaatcatcaatgtgttgtaatagcacataattgtcactaggtggcgcaaaagcctcaagatctgtagccaaggcctcctcaaaaatggtagaattcttaaacccttacggcagccttgtccaggtatattgcgattgccccctctgactttggggagcaagcttcaaacaaaagaaggcatcctttaagtccagacatgtgatccaagtggcatcagcaggaatctgtcccaacattgtgtatgggttgggtactgttgcatggatagcgacagtggccttgtttaccacccggagatcctgcactggcctgtattccccatttgatttgtgcatgggtaacagaggagtattccatgaggacttgcattttactataatcccatgtgtataaagccgattcagatgcttttgttattccatcaattgcctccctgggtactgggtattgacggactcataccggggcagcatgagggttaagctctgctaccactgggggtctgtttgcagcaagtccagggtattatcctcggcccatacacctggtaccttgaaaagcatcccccatatattgtgtaggtcggttctggtgaccttctggcacacggttcacacagccaccattcctcagcccttgggacagttggagttcataccattgccttggactttccaaactccagtgtcatattccctttaggcgtaaagaaaatttctgcctgcagtttctggagtaagtctctccccagcaagggcactggacaatttggcatatacggaaactcatgctgcacttcttgtcccccaataacacatctcctggatttgcaaaaaggtctcttttttttggccccagtagcccctacaatagtagcacagttctttgtggggaggctaattgggtgagttaccacagagaaatcagtaccagtatcgaccaaaaaaatccattaattgaccccctatttccatagagaccataggctccccggggcctaaaaagatggagcctggtctgtctcagtcctcaaaattcttggcccctgctaagccaatcagatcaggatctgcccttgatgcaccatgactagcaaccgaataacgcacttgggtgttagaccattgaccatcatttccatccttttcctttttgggtcactcatctttccagtggcccattttcctgcactttgcacattggttcctgtccaaccaagattggctttcctctcctggtcttgtctgcccccttcctcgacctctgccttggccacgccctctagcaaattcagggttactttctgctagtgcagcagctataaattgagccatctctgttcctatatctggtttttctttcttcctttggttgggctgcctgagccactaatgccttataatatctctttagacagggctgtagacacttggggtgagtttgtgctacactgagccaagagtctatatagggaaactggtctgggtatcctggttgtcttccaactccggtgaccacgttaaacacacggccaattaattttctgtctattgtaccttcagagggccaccccacattgaaagcaggccaatctatttcacagtatgtccttaacttttgagcatccagtttcatcccataatcacctctaaatccttttttaaaattctttatcacgcactccaaaggagttggcttcgacacttttcctcccatttcctcccttgcagtgcactttccctctcactttcactctcagatccaccagaccaggtccttttatgggagtttcagacactgcttagccaggaatgtgccttcccctgtcacagcctgctgtggctgtgaaactggtcccattggccgtatgcggcatcctaggtctgatttcttccacgctcaccttggagtacacagcctgccctaagggatctgtgcctcctcacgttactccccgcattggcctctcccaagaccatctctttcatacactttcacacacctcccctgcccaggactcctcatcagacgaaacgagcctctctcatgtcctgggtgggttcacacacacccacacactcccagttcctgtctccagatccagtaaaccactttcactttgttaatggggacacgaggttcatccaaattagcaagcctctcctgccacccccagctgctctgggttggattagtggtcattccctgggaggtgatcatccttatgggacaggcttccctgccttaggcacttgctccttactacagttcctgaagtgctggcatcgtcctgcagccctgttcctggttctgttgcattgccgggcagtctgctgggatgtggggagagccagtctctgtctgggtgaagctcccctgtggcgtgccttggatgctgggtctccccagccctggggctctagtcccccaggcaaatgagacagtaaatctgttgtctccaatcccaggcgagttcccagaaatgttacgagatttttaaggaatcagagagaccaatggggctcaggaggatatttattaattatttaggtgcactggtccagtcggattaacatccaaaggactgagccctgaacagagttaagttaccttttaagcatttcgtgggtcgggggagatctgtgcagaggaaagtatactacagaagtgagaaacaaaggcaattgagacatgcattatatcattttttacttttcaaggaaaaacatgttttgcaacttgagtttttctgtctagtgaccttgcagctgcacagctaaggagacagggtcttcacaatgcctgggaaagtgggagagataaggctcactagccacagaaaaacaggcagttaattttaaaggacttcagctctttctctttcttagggggaattgggttttcttacatacaactgagtttctgcttgcacactctttaatttcttttaattcctgttccatacatacactggaatattcttttggaatgtgttcttccttttctttctaagggatacaggcacagaaatttgtggcctatagctgactgtcctgttgagaattactgaactgaactgagctggttgagaactttgttataactttcacattttattgtacttttgacaaagggcaaaagaaaagttaagttctgtgtagaataaacccaaagctatgtttgcataatcttatcagttgttttgtatgttggcagatactatctttactttcagaaaacacagagagatcaattattatacttgatctacagagtgctcagataatataataaagtaagtatgtgatttctactatgatcccaaagaattatattcacaaaggcagtagataaaaggtagggaaaacaatgagaacatccagtattacttatacaagaaaacaatgtgatttcccatgtgtttaagagtttcattgggccgggcgcggtggctcacgcctgtggtcctagcactttgggaggccgagggggcggatcacgaggtcaggagattgagaccatcctggctaacacggtgaaaccccgtctctactaatggtacaaaaaattagccgggcgtggtggcaggtgcctgtagtcccagctactcaggaggctgaggcaggagaatggcgtgaacctgggaggtggagtttacagtgagccgagatcacgccactgcactccaggctgggcgacagagtgagactccatcacacacacacacaaaaaagagtttcattgatacattatgtgcatcttcttttgtgccacttaccacatggttacatggaggagtgttttgtttagcatatacattttccttctcatgctaatgtattttgtttttagaggctaaaaagcagtcaaggtccagggagcccactcttttcttttaccttacagaccttggtgtttgcggtgggtctatagggtaatcatagagttttcaggctaagcctgtaagagtggtccaccgtagatatgaccttggacctgactggaaaagagaaaaacatcaacatcaccatcagatattcagccattagaggaacagctttgccacagtattttagttctgcacaaggcactattcaatgaggcagtccactgtgtggcaaacacacctgttcaagtgaggctggattgttctgagaggtcttaagatttcatgactctcaaggatctgcccacctgggactgaccagcacagtactcagggtctatggacttcaatgttggaggatggacctcagcttggtaaaatcctgggctataaccacctcctcttgtaaccaaaaagcaggttaattggacttagagtccaattaacaagagcaaggccttgtacaagaaaagtgaatttatttccgaagctagctaggggaaggggcataaagtgtcttgttttaaatgtgatgcttcacctttgtagcaaaagtgaaatcttttctaagttgaccagagaagtgagcaagggcagggggtctccctgctaccctggtttcttatctaccagacagttgagttggtgcctttctgggcagaaataagttgtaaaagtggctaaatggaaagcatgccctcctgaggtgaccctctggaggtgggatttctgtggggacatgctttgatctgcacttcaactatcaactctagaggagagctccatcttggggcacacggatgaacttgcgctgtagggaaagtctggtgactgggaggagagaggttattttgcatttcaaaaagggctaaataggaagcagggggaaaggagaaaggagaaaagaacagaaaaaaataattaaactaccacttagaaaaatgggggtacttggttacactcttatttctgaggtcagtgtggtgccctttatcttgaaaggatttaacttcggctatagttgcttagaacttactaaatctaactttgaatcatattttaagttagaaagtattttgctgtcccctgcttggcctttctagttatcttttcacatgaacatgctttatctttccaactaggttgtgaggatggaaacattagttcattcagcttttcttccccatagtgccagacacctaggtactttaaaggtgttgacaagctatctactggctgagtggcttatttgagaaaaatacaatgtcagaatttcacctgcacttcattgctgggagccatcagcttgctagacgtagacatgaagaggagaaagcatgaagagaatgggcaagggggaggagggaatgagggaagaagataactaagggatggtgtaatagggagggcagagaagagatgggagaaattgagttgtatgacttcagagcaagtgtccttaaacatagggcatattaggaaagactatgcccccttaaagtttggatggaacctaaaatctgtacacttgtcagctaaattggtctcctttgataatattggcaacatgtgtcacgaagattagacacagaaattggagagattgtaagaagtgtgcagaaaatatttccatggaagatccagcctagttggcagcctcaggtaggatcataattgaaatgctagaatgttacagtaggcattgttccagggctaaaacttgttattcataacttcaactctaattttattcacttgaattttcagagtgcagctgtaaggggccacaaaaggttccctggcttagttgctattctgtaattacatgtaaagccctgatcaacttcccgaaagcctgtgcaaggcttttctttctttcttttttgttttgttttgttttttttttttgagacacagtctcgctcagtcgcccaggctggagtgcagtggcttgatctccgctcactgcaagctccgcctcctgggttcacgccattctcctgcctcagcctcccaagtagctggaactacaggcgcctgccaccaggcccagctaattttttttgcatttttcttttttagtagagactgggtttcaccgtgttagccaggatggtcgcgatctcctgacctcgtgatccgcccacctcggcctcccaaagtactgggattacaggcgtgagccaccgcgcccggcctgtgcaaggcttttcttgagagcatgtgctgagacaattttttatttcaaatcacagaattaagaattatgtcattggttagaagggtagagcataacttacattagtatatttgcaatgacgtatttgctttcctgaggtagtgtgaggaataagaaggcaatagatattcatatttctgagtgtacttttataaagtgaaacacttttgaaactcactgtttaaacaataacaaaaaacaaatattgtatgttcttactcataagtgggagctaagctatgaggatgcaaaggcataagaatgatacattggagtttggggactcggaggaaagggtgggagtggggtgggggacaaaagactacaaattgggttcggtgtatactgcttgattgatgggtgtcctaaaatcccacagatcaccactaaacaacttactcatgtaaccaaataccacctgttccccaaatacctatggaaataaaaaaacaacttaataaataaattctaaaaataataacaaaactcacaaatctaaagaaacttaaatgaaaacctggccaaaggttttaccatttttagcttctgagttatgcttttgttttattttaactgatattcttgaaatatttaattttataaaactaaactttgaaatgtgaatgtcttttcccttgacatcactcgcagtatcaaaaagaagtaaatgtattgctgtgtatgtttagttatatctatgattatatgtatttcatgtgcagttgtacatatgaatttagagttgtcattttcaattaatttataaaatttttacagttctatgttactcctataattggtatgtgacaaacctctcagtgttccttctacagatatccaactttagatactgataataagaattaaattaatagctttcgtcacttactgagtccctgctctttacctgccaggcgcagtgttagacatgcatgcattgcgtctttcacttgtcacagcaatggtgtaaggtagatgttattcctatcctcacctttctacctatctcctactaaggcagcacaatgtatctcagctgatttaaggagttaaatttaggtaacatcaaatcaagtagaagtatagaatttaaaaatcatcagtgcaattatttgataaagcataatgtcaactctggaagaaggataacttttaaagttatgaagcaataaaaaaatcagaaagaaaaatatggaccacaaaactaagaaaaagaggaaaacaacagaatggggaaatatttgtagtgaaaaacgtaagcattagttattttaaatgtattttttaagttattaaacattggaagaataccaccaaatgtccaaacgttcagtgaagaataaaacaaatcacagaacaaaaagcacatagaagagccttaaaaaaggtgttaacttcactatgcaacaaggaactataaatatatttttaaattaaatttatattttattttattatatttttgagacagaatctcactctgtcacccaggctggagtgaagtggtgtgatctcggcttgctgcaacctctgtctcctgggttcaagcaattcttgtgcctcagcctccagaggagctgggactacaggcacctaccaccacgcccagctaatttttgtatttttagtagagatggggtttcaccatgttggtcaggctggtctcaaactcttggcctcaggtgatctgcccgcctcagcctcctaaagtgctgggattacaggcatgagccaccaagcctggcctagttagtataaatataacagtgtcatttcatacctaattaataaataaagacaagctgaaaatgataaaatacaacgttcctgtggctgtggggaaaaacatgtattgcaaatggcaatgataataacaataaccaatattgtgcccactttcctcttgtgcccacatctctgtgcagaggaactactgtttaccccattttgtagatcagatgactgtgactcagaagggaggggtaagtggtcccccatcacacagttagtatggtgttttagtccatttttgtgttactgtaaaggaacacctgaggctgggtaatttataaagaaaagaggtttatttggttcatcgttctgtaggctgtacaagaaggatgacaccagcatctgcttctggtgagggcttcaggaagcttccactcatggaggaaggggagcaagtgtatgtcaatcacatggtgacaggaaggaacaaaagataggggaggaggtttcaggcttttttaacaagcagatctcaggggaaataatagagtgtgaactcactcattataccaggtcagcaccatgccattcatgagggactcaaccccatgatccaaacatttcctgccaagtctcacctccaacactggggattaaattttgacatgagatttgcaggggacaaatatccaaactagcctaatagagctttgttgaagttaaaaacgctatgttccttttttttattttacataaaaccatttggaagcttttttttttttttaaatagagatgatgtctcactatgttgcccaggatgttctcaaattcctggcctgaagtgatcctcctacctcacctcccaaatctctgagattacaggtgtaagccacggtgccttgctgattattttttagaggcagagtcttgctctgtggcccaggctggagcacagtggcacaactctagctcactacagcctcaaactccttggctcaagggatcctcctgcctcagcctcctgagtagctaggactacaggcgcgtgtcaccacacctagcctaaaaaccatgtttttaaccaaaactggatactgcttctcatggcaatatacaagaaaaaaagaaaaggttcaaactctttcacttatgtatttcagttctggcatgttagcccaaaaatgctaatttaggctgagtgtggtggctcatgcctgaaatcccagcaatttgggaagctgaggcaggaggattgcttgagtccaggagttcaagaccagcctgggcaatatggcaaaaccctggctctacaaaaaatttgcaaaattagctgggcatggtggtacatgcctatagcccaagctacacagcaggctgaggtgggaggatcacttgagcccaggaggtcgaggctgcagtgagccatgattgagccactgcactccagcctgggtgacagagtgaaacactgcctcaaaaacaaaacaaggccaggcatggtagctcacacctgtaatctcagcattttgggaggccgagatgagcagatcacttgaggtcagaagttcaagaccagcctggccaacatggtgaaaccccatctctactaaaaaatacaaaaaaaatagccaggcatggtggcacacacctgtaaacccagctactttggaggccgagacaggagaattgcttgaaccggggaggcagtggctgcagtgagcctagattgtgccactgcactccagcctgggtgacagggtgactccgtctcaaacaaacagaaaacaaaaaaggaagcaaaagaaagtttaaaagtagccatatgtacaaagatgtgcattcattcaattgatatctgttgatcactcattatgtgtcaggaaacaaccttaagcaaattacaagatacgaatgcagacattaaaatgaaaactatgaagaaaatgataaaatgttgaaaagcatttctgaaatagtgttaaatggaaaaactggaccacactattggatactgaaagtaatcgttcactgagttaggtccaagagctgaattgagtcagagaagttatgtgatttggggaaatttctagtaagaaacttttcaatggaaatcttaattgcccgacttttgtggcaccagaatgtatactttcacataaaagccaattttgcaattgtggttcatttgccagactcctgattggtgggactttaggtcctcagagaacaaccccacctctcctattcccaactctcccacctccaaatggcgcacgatgttcttgccatttccggagagcagcctgtgtttcttgaatgggaagtgaggggaggccagagcacaccaatgacaggggagggaggcagggaaatgctgggaggagaaggcggggtccctagcaagggctccaccccggtcctgtgcccatggaccaaagtgaggacaggcatttctgttttcatgcccaaatgttgcatttcccaagaccaccctggcccaccacgcccccatcctgtgcctataaaaaccccgagaccatattggcagagacacaagtggccatgggcagacagaagtggctggccctcgagaggaacacactggtggaagagcacaccggcagacaccagcagacaccagcagatgccagcaggccgaccagctgaacaacactgactttggctgtggtggtcagaggagagcctggccgctgggtggcctgactccaggggaaaatcaccttcccactccatcccccttctggcctctccatccacctcgctgagagctaccaccactcaataaaaaaccttgcacccatcctccaagcccacatgtgatctgatttttctggtacaccaaggcaagaacctgcgatacagaaagccctctgcccttgcgataaggcagggggtctaattgagttgataaacacaagctgcctacagatggctaaactgaaagagcacacggtaacacatgcctaccctagacactgcagtgggattggagtcacatgtcactatactgatctcttctttgcaataattaagttgtttttctgttacagcttttttttttttccttttttttttttttttttaagatggagtctcactctgtcacccaggctggagtgtagtggtgtgatcttggctcactgcaacctctacctcccgggttctagtgattctcgtgcctcagactccccagtagctgggattacaggcatatatttagtggagacagggtttcaccatgttggccaggctagtctccaactcctgatctcaggtgatctgcacacctcagcctcccaaagtgctgggattacaggtgtgagctactgcacttggcctatgttatagcttcagggacatccagcttccattcattaccggtcttcccaatctgtgaccctgcagcatggactagcacatgactgccacttagagcacccatgcaggactccggaggggagccaatagggagtaggggttgtgcaggaatgtattatggtctgtgttcattcgactctacatgaaggcccttcccaattatatcaataactttttaagagatttcaacactaaaaaaagcttttaatcactaatgtgtttttggaaggacctgaattatgtacttttaaaattaatttttctcgtgaataaactagttattatttttagttaatacagatttgtacggatttgatacccaactgaggaactggctttgtgggtcccactaacaactggcttgacaagctttatgatgatgaattgttcctatttttataggaaggagtttgatattaggccactgtgcatatggaaaatttcccaaactcctggattagtcaattggaattttaaattggaaaatgctctcataaatagacgattgtttcttgttttatctcactgggaacaacttgacagttgtgtcttctaacaggtagaaacgtggttgcagcttgtgggggtgggggtattctgatgaccaaaaagcacagggtgaaatggagtgatgtgaccattccagggtgctttctagctaaagatcctgtgtgtgtgcatgcatgcctacatgcacgtgtgtctgcaaaagagagaaggaacagccaaaaatataagctcatggtttggaaggagaattcaagtgctctgctgaccaccaagttcctagggaaacaggttgtgagagggattgagaacaaggaagcctcagaatttggtcaacaacccagatctctcagcacagccaatggctcattgtgccatattttaaatgcaattgaactgtcaattcacatccatgcatgaaagacaagaagcattattattcctgtattatcatacaggaagcattattaaatataaaatggtgtttggctttctttggtctaaaaactaataaaagtaggtgctaaaggaaatttttcagtagaaaggcaccaaggactgctgatgatcccacatttaaaacaaaaggtcaatttcttaaaaattgcatacttggtttatcttccactttcctttcccttaaaactaaaagtcttttagcacatgtaccacccctagaatttctggtaaaccagcactagcctgaggatcatgttctcatcaaagggtaaaaagaagggaaactcgagccagcctaggaaggacccttccttgtgctgctaaccaccaagactgctgttcttacagcagaaaagggatggactcatcatacccgagtcaaagcaccaccccctccagagtcatgggccatagtcccaggggaaaaccctaccaaactcaagctaagaaaaatttaattctttcatctattctattactttcttctttcctcgctctattactgaccatgtagttattaacataaccaagtcaatttcgcctcaaactattgcatttaatgcttgctttgttataccctgcagggacttgctaagccaaaaacagctctctacttcaaaaaagtacctctgtccctcctgactctcctcagactgggcattagtaaattaggaccatctaatccagggagatttcaataaagaccccagtgtcaaccaggagtcttgccccccgatgtggagcttttatgccgtagttggtccaaagttctgtggaccactaaaaagcaagaatgaactaccccaaccagtttttgtaatttcctaaaaccatacattcattttactaaagaatcatagaagttaaagacttaaaacaaactttggcaattaaggcagtataccaagatgcaaatgcctggttggaatggatcaaatattctttccgcacattaaacaaaagcaatcgttatgcttgtgcacatggcaggccagaggcccagattgtccccttttcactaaggtagtcatccagttgaccaggtgtgggctgcatgatagctctttttcaggattctacagcctggagtaataagtcgtgccaagctctctccgctatgtcctgaagtctggcaccctgcgagtcagcccctgagggccatccagcttccatctcccaacactaagttcacttcatgtctctcacaacagggagaaaacttagcattccttggagacctgaagggatgcagtgagcttaagaattttcaagagcttatcaatcagtcagcccttgttcatccccgagcggatgtgtgtggtattgtggtggacctttactgggcactctgccgaataactggagtggcatttgtgctttagtccaattggctatccctttcaccctggcatttcatcaaccagagggaggaaaaataagacatcataaagcgagagaagcctcttatgggtctttcgactctcatgtctatttagatgcaattggagtcccacgggaaataccagatcaatttaaagcccaaaataaaatagctgcaggatttaagtcaatattttggtaggtgacagttaataaaaatgtaaagtaaataaactacacctattacaaccaacagcaactagcttttcaggagttaaaagaaaaacctcatgttggctgcagccctggggctacctgacctgaccaaaccttttacactgaatggcagttagagatttaacccagactgtggggccctggctgaggccagtggcctacctctctaaataactagatggggtttctaagggttggcccccatgtttgagggccttggcaggaacagccctactagcacaagaagtggataagctaactcttgggcaaaacctaaacataaaggccccccatgctgtggtgactttaataaataccaaaggacgtcattagctaacaaatactagactaactagataccaaagcttgctctgtgaaaaatccccacataaccattgaagtttgcaacaccctaaaccccgccaccttgctcctggtatcagagagcccagttaaacttaactgtgtagaggtgttggactcagtttattctagcaggcccaacctccaagaccatccttaaacatcagtagactgggagctgtacgtgcatgggagcagcttcgccaacccctgcaaagtgactctgaagaagatgacaagccctgccccagtcacacctggaagctgactggtccttgcatggtcaaagcatgaggaaactcatcgcaggactcatttcccttaaaatttggacttgtacagtaagaacttcaactgaccttcctcagactgaggactgttcccagtatatacatcaagtcactgaggtaggacaaaagattgctacagtcctattattttatggttattataagtgtactgggactctaaaaggaacttgtttgtataatgctattctatacaaggtatgtagaccaggaagtgaccagcctgatgtgtgctataacccatcctttttcctactgcccataaaaacaggcgaacttctaggcttcccagtctatgcttcccaagaaaagagaagcatagctataggcgactggaaagatgacaagtggccccctgaaagaatcatacagtactatgggcctaccacttaggcacaagatggctcatggggatacccaacccccatttatactatcaaccgaatcatacggttataagctgtctgagaagtaatcactaataaaactggcagagctttaactgttttagcccagcaaaaacccagatgagaaatgctatctatcaaaatagactagtcctagactacttgctagcagctgaaggaggagtctgtggaaaattttacctaaccaattgctgtttgcacataaatgatcaagggcaagtagttgaagacaaaaagatatgacaaaactggcacatgtgcccatgcaagtatggcatggacttaatcctggagccatgtttggaaaatggtttctagggctaagagcatttaaaactcttataataaaaattataatagcaataagaacctgcttactactcccttgtttgctacctgtactcctacaagtaataaaaagcttcaccgctaccttagttcaccaaaatgcttcagcacaggtgtactatataaatcactattgatctgtcttgcaagaagacatgggtagtgaggatgaaagtgagaactcccactaatgagtgaggttctcaaaggggggaataagggaggagaccacccctcatattgtcatatgcccaatttctgcctcaaagaaaaagtaggagttaaaagacagaagtgaaatcagtagtcagacagcccagcactgcattccaggcctggtagttaaagatcgacccctgacctaattggttatgttgtctatagattccagacattgtatggaaaaacattgtgaaaatccctgtcctgttctgttctgttctgattactggtgcatgcagcccccagtcacatatcccctgcttgctcaatcgaacacgaccctctcatgtggacccccttagagttgtaagcccttaaaagggacaggaattgctcactcagggagttcggtttttgagacatgagtctgccgacactgctggccaaataaagctccttccgtctttaacctggtgcctgaggagttttgtctgtggatcgtcctgctacatttcatgtcattaggaccttctgagactgtgtcatgggtgcatccttaactttggtaaaataaactttctaaattgattggaacctgtctcagatacttttggttcacaagttggtaaccaggaatggcttctgagtggaggttcccctaacctttgacaaatctcctattggtgcttggtaccagtttgagctatctttattgttcaaaccaataggacaatttgtgaagtcctgggagctcccccttcagagaatccatgatctcctcaaatttggctgagatctaaggtttattttgttgtacaactccttttctggagttttacacaaggaaggtgaattgtcctgcttcatgttgatggagagcaggcaactcctttttggagtgtgagctcacttccaacagggaaggtgagttgaagttgtttcctgcttctaggatggtagagagccatcttcagactgggctccattcctaggtaagtaactgaattgggattttgtcttggaaattctccttaatgactaaagttaaaattaacaaccagctgctcttaatttctacttacctttagagtgctcagtaattgtataagttgtgcaattttttgtttgttttgcttaactatttttgtttgtttctatttttgttcttcttttggtcttttttccattggatttgataaactctatcagacttagtcaaatctgaaggaaatttccaaattatggggaacaatgccactgaattagctaaattcccacagctggggaaaaaaaggaaaaagaaaaaatgaccagcaaaggggaaaaagaggaaagattttaactactgaggggttttacttacataacaaggccactttttgctagccaagccaaactgaaagagcaacagctgttgtcccatggtgcagttcagtagctatggttctgcccttttttcccaccacaacaccctgggtttggttcctaaatcaagtcctttcaggtttcatatttatgttactgttgaagtatgagcaatttgtctcagttaaaatatggcaatgagatttaaaaggatttttctttgagatggagtcttgctctgttgcccaggctggagtacagtggcacattctcggcttactgcaacctgcctgctgggttcatgcaattctcctgccttagcctcctgagtagctgggattacaggcatgtgccaccacaccaggctaatttttgtatttttagtagagacagggtttcaccatgttggccaggctggtctcaaactcctgacctcaagtgacccacccaccttggcctcccagtgctgggattacaggtgtgaggcaccacacccggcttaaaaggatttttttttttggaagagctcaatggctatgaatctgcttaattaaaaagctaatattgaagattttgggtgtgtgtgtgtgtgtgtgtgtgtgtgtgtgtatgtgtgtgtgtgtgtccacttaaaaggcctttatggttttttttcctagaacttcattttttttgtagaaaaagttttgtttttctcagttgactgaattctgttttctccatttttcttcctgtctctccttccttttgcccctctctgctgcatgagggacctaaaatggtttttaacagcctgagattccttaaagaaaacagagaaggtgccagactccattttggggagaaacctctgtttttccgtatggaaccttaagagtataaacagacaagttcttctcaaatcttaaatagcttgcttttgtattgttacctgattttgttttgactaaagtagttattacaacagtggctattcttgggtgtttaaaatcagaaagagtatagtttagacactaagagaaatgtcttcacaaagaaagtgcattataaaagcatcacatgttctaggctcatgaaaatttctcttttggagattcagaattcagtgtgggctctgcctcagacctcagagatccagttaaatagtaagagactaaatttaaaactacctatattgataaaattggtccccttatacaatcctatgatagatttttacaattttatgtttgatttggcatctgtttttaatctccctctagaataccagactctttttctctttactttgggcagtatggccattttcacaatattgattcttcctatccatgagcatggaatgttttttttccatttgtttgtgtcttctcttatttccttgaacagtggtttgtagttctcgttgaagaggtccttcacatcccttgttagctgtattcctaggtattttgttgggaaaactggctagccatatgcagaaaactgaaactgcttccttacactttatacaaaaattaactcaagatggatcaaagacttaaatgtaagactgaaaaccataaaaaccctagaagaaaacctaggaaataccattcaggacataggcatgggcaaagacttcatgtctaaaacaccaaaagtaatggcaacaaaagccaaaattgacaaatgggatctaattaaactaaagagcttctgcacagcaaaagaaactatcatcagagtgaacaggcaacctacagaacgggagaaaatttttgcaatctacccatctgaccaagggctaatatccagaatctacaaggaacttaaataaatttacaagaaaaaaaaaacaaccccatcaaaaagtggttgaaggatatgagcagacacttctcaaaagaagacatttatgcagccaacaaacatatgacaaaaagctcatcatcacttgccattagagaaatgcaaatcaaagccacaatgagataacttctcatgccagttagaatggcgatcattaaaaagtcaggaaacaacagatgctggagaggatgtggagaaataggaatgcttttacactgttggtgggagtgtaaattagttcaaccatagtggaagacagtgtggtgattccttaaggatctagaaccagaaataccatttgacctagcaatcccaatactgggtatatacccaaaggattataaatcattctactataaagacacatgcacagtgtttatttcagcactactcacaatagtaaagacttggaaccaacccaaatgcccctcgatgatagactggataaagaaaatgtggcacatgtacagtatggaatactatgcagccataaaaaagaatgagttcatgtcctttgcagggacatggatgaagctggaaaccatcattctcagcaaactaacacaggaacagaaaaccaaacactgtatgttctcacttatagatgggagttgaacattgagaacacatggacacagggagggaacatcacacaccagggcttgtcgggggtggagagctaggggagggatagccttaggagaaatacctaatgtagatgatgagttgatgggtgcagcacaccaccatggcacgtgtgtacctatgtaacaaacctgcacgttctgcacatgtatcctagaacttaaagtataataaaaattgggcaaatgaaatgaacagacgcttctcaaaagaagacatttgtgtggccaacgaacatataaaaaaagctcaacatcactgatcgttagagaaatacaaatcaaaaccacagtgagatgccatctcacactggtcagaagagcaattattaaaaaaatcaagaaacaacagatgctgtcaaggctgcagagaaataggaatgcttttccactgttagtgggaatgtaaattagtttaaccattgtgaaagacaatgtggtgattcctctaagacctagaaccagaaataacatttgacccagcaatcccattactgggtatatacccagaggagtataaatcattttatcataaagatacatgcacatgtatttcattgcagcactattcacaatagcaaagacatggaatcaacccaaatgcccatcaatgatagtctggataaagaaaatgtagtacatatacaccatggagtactatgcagccataaaaaggaacattatcctgagcaaactaatgcaggaacagaaaactaaatactgcatgttctcacttataaatgggagctaaatgatgagaacacatggacacatggaggggaacacactcactagggcctactgaagggtaggaggagggagaggataatgaaaaataactaatgggtactaggcttaatacctgggtgatgaaataatctgtacaacaaccccccatgacacaagttcacccatgtaacaaacctgcatttgtgcccctgaacttaaaatgagagttaactaaaaaaataaaagaaagagaagtgttctttgtggcattaattttaaaggatctctctctttgaaaacctagactgcaggtaaattatcatgtaccacaatgttttgcttatcttttctgcctcataccaccgtcctgcctgaatcctgccttaatttctggcacctggaagtagagacatgttaaaaaacagtgtatatgactcttgaagatgctacccacttctggaaaatgtattcacttttattttgcttcttccaggaaatctgaacatgaaaaaagaatattctctgctagtgtgtgtcagactggatgtgaggattgactgaggatttctgctgagcactctctggccttcagtttcagctgtagccagtgcagagaaggtgtcagtcctgggtctgatggtgtcttggagcttatttgtacagacccattaattctgaggctgcttaaagcattgagaaatttactgttttagatggaaagtgattaacactgggaaataatttttggtttcaaaatcatcctgtgagagtggtgaggtacattcttcttggattttccacactcccaacagggcctggggcttctgtgtagcaataacaaccctctctctgtggaagccacacattatgcatactactttgctgaaatttgacaatcacaagtggaaaaaggaagaagtaaggaattaaaattagcaggcaccatggcatgcttttccaaggaaacagagccttcctttacactgggaacatatgagcactattaaactggtctttgattaagacccatgagaggaaattgtggggtaactctgataccttatctatagtcactgcaatcactttatagtatgactgtggggcccacaattaatcagttttaacataaaactccactgaaggagactcatattgctaaaggttactcaaaaacaaaggttaaactgagaagaactttatgctttaaaaaatgggctgggcctcttcatcttcctaatttatttttgtttttgttttctttctatcctggaagttttgcacaaagaagatcgtgttgatgaaaagagtaaaactctgtaaaatatttgaaaagatttattctgagccaaatatgagtgaccaatggcctgtgaaaactctcaggagatcctgagaatgtgtgccccaggtggttgggttacagcttggttttacacattttaagaagacataagacatcaatcaatacatgtaagatgtacaacattggttctgtccagaaaggtgggtaaactcgaagtgggagcttctaggtcatatgtagattcaaagattttctgattggcaattggttgaaaagttacattattgtctaaagaccaagaatcaatacaagagaatgtctgtgttaagataaggggttgtggagaccaaggttcccattatgcagaggaagcctccaggtagctggcttcagagagaatagattgtaaatgtttcttacttgagttgattctctcctggatcaagaaaaaggcctgcacaagaaaggggattctcttgagaatgtacatttccccccacaagagacagctttgcaggactgtttcaaaatatgacaaagaaacacatagggtaaaatacttttgatttctttcaagccttgctatctgtcatgtgatgctatactagagttaggctggaaattggtgtcttattgccacagagtatgttagtcttaagttctgttctaacgttaagactggtcagctgtacacgaattccaaaagggagtagggaataataaggcatgtctgacgcctacttcctgtcatgacctgaataagtttttcaggttaactttggaatgcccttggctgagaggagggatccattcagatagttgtggggcttcgaattttatttttggtttacaatagcatgaacaaagcagaggtctgacagcttcgttccagtgagtggatattctggaacattgctcagggtaccatcttcttactcttctttgagcagcactaaatgaaaaggtcccctttcaccttgtaatcagcaggaagtgggattctctcgaagatgttgaagatgacaaaataaacttaaaggattgttcatctgcttttgagctagggaaggtataacaatatgctttctgggccggggggaggggagaaaatggagaagagcctctttttgggcttaatgaaatttttgcttgtgtttcttttgaagcagcaggatctttggggcagaatagctcctattcccctgtgtcccccacaaaaagggagggcagtgaacagaatttggagcatagtggagtggatcaacgttcagctgccaccttcccataaatcctatgagtagccacctaggaagtttctctttagagtccagaatttggactgaactagtcagcataactggaactcagctttatctgggaatacactgttgtctcaccaggaatctgcttcaccccttcttgcacatatttgtggtccctaaaggggcaaggtggtgaggatggcataatggcaggggtagggagggggagtggagaaggatgtatgggtcagtgcaaactcacaatgacgcttggtaaacttctgtgatgtgcagggcctattgttgatggcaagccagggatgtcatttcatgaaagatctccttgtcattttgtttaaatggctttctttttttttttttttgatatggagtctcactctgttgcccaggctgaagtgcagtggtgcgatcttggctcactgcaacctctgcctcctgggttcaggcctcccgcatagctgggattactggtgcctgccaccacatccagctaatttttttgtatttttgatagagacagggtttcaccatcttggctaggctggtcttgaactcctgacctcctgatccacccgcctcagcctcctaaagtgttaagattacaggtgtgagccactgcacctggccttaaatggctttttaaaaacaatttgcacctataccctactaaccacaattggcacacaaaaacaaatatattgagaatttgcctctttattgataacataagtgcagaggagataagggtagcctgagcggcatgggcagcccaggtgtcagtggcaccagaaaaacccatctccaaactagctcctgaagaaggatggcattctagggctagtccacgacgatgtagacacagtcgtctgggtcagcacgtagttcattggcgagcattaattctctctgatgtcgcctacatctggcccttttattcttaaaccaaacctacaatcagagggaaaaggggattggtttagtatattgaacagttaatgtcgtaatagaaaaacacaggatgcaactttatatgctattgagattttaaactgcatcaggaaaagctatttcctcattgctaaaataccttaggaaagttaacaacatagcccgtggcccttcagctcacccttagtgaggaccagctttgtgccaagtcctggaataagcttattactttgtatctctcttctccattttatttatttatttatttattatttatttatttatttatttatttattttttgagacagggtcttgctgttttgcctgggctgggatccagtggtgcaatcatagctcactgtgacattgaacttctgggctcaagagatcctcccacctcaccctcccaagtagctggtactagaggtacatgccactatgcccagctgttttaatttttctgtagagacagggtctcgctatgttgcccaggctggacttgagctcctggcctcaagtgatcttcccaccttggtgtcccaaagtgttgggattacaagcgtgagccactgtgcccagccccaattttaatattctttaatggttacttccagatattggatgcagttctggcttatgagttgttccaggtccttgctgtttgttaattcaatgcctggcaacagggtaacaaaaggtgtgcatctgacaagtgaccatcaactatccagctgcctcctgctccctcctcactagggagagtttcatcttgtttgtgggagaagttcggcatggtaaaaagtgggcctaatttcaaatcattttcaggggattgtttaaaaaatccatctttagtatgtagtaaataataggaaagagcgcactggaattttagacaggtttccttccaggatgtctaagggatcattcgtcctctggcaagagaggcctggacactgccttgatattttagcctgtagcattaaggaaagttgaaaccagctcgacccaaattaactgaaactctcaaaaatctttgctcacccaatagtttaggggaaagaggcataccattgtcaccaatgccaaatcttcgttctccaatctgctgcactctccaaaccttcctgggctcaggacaaggtcagctcactctgttttacctacagctccaggatcctggactggaggtgctgtagcccagtaaggcagggccccctaggccctgctactcaaccaggagatctgaatcccaccccctattcctaaggcagaaaggtggaaccagcattttaggaagatggttaacatcaatgtgggggaagggtcacaaatatggctcctccctaaatatctgccaacaattaaaaagcaaacagacaaaaaaagcctgtcagttagatgtcactatcctctcagcaacctagttaacggagtttatattgtatttattactttcaaaagttctcaaactgcaaattgtaagctgcacaaagggccttctttctctacctgacacgtctttttcactttcccagttaaggatttgcagtatttctgctgcatgaggccagtctctaaaagtctaaaagagctcattttgggagctttcaagtgtaccactggtcaaatctctataaacataaccaaagtgtacagtgggttaactggtatgttctgatactaggtctgcattcccaatactggtttcataaaccagttgcattacatctgcaaaagctatggggaaactatgtattactttcttgggggaaatttatgctgtatagtttggagatacatgagagcattctgtctcttcccttatttgtatcttgtggctcatattcttttcagagcactaaggagagaacattatgtcgactcagggaggagaaaaacaactcaccaagccttgtttttcttttcctctgagtttgccttaccagctggagaaaagtgatcccaacctcttttcaacttctccaacccgaaccaggtgtgattgtgagtccaccctttgccattaggatgccagcactcagtaacccgctttgttagtttgcttttttggacaacccactaccagatcggcagtgcatttccctcactacactcacacatgcactctgcataaaagctaataataaggtcatcctgatttttgttttttcttttttgggaaaacatcactttgatactatgtatggttttctttggtcttaagtggtcatcacttgaatcctatgacctactaattagttaacactgcttaaaggaatgaaaagtatttgaaattaacatgggtgtgaatctaccctaaaatgagggccacctctccaaacaaattccagaaaacccacctcttcaaaaaagtaccaccaaaaagaaatataaatccttagatggatagaaattcctcaagagaacagtcacttaaacatttagtagtttcataatgttgaatttgtatagtacatgcatagtatgtgcaaagcctattttgaccatatttctctctaaccttttcacccttcttggtcaactgaaatgaattcaatattactcattttgtttgcttcattctttagacaattttccaaagcatacaaaccttacaaaccttcctcaatttcaaaataatgtgactattttagcaatattttcaggttgacacatcaaagtattttagaaaattaaaacttagggctgccactctctatactgctttaccaataacttaaaaacaaacaaagaaggaccaggggcttggacatataagctatcttcccatcagtctcagcttaactaagtatacattatttagtcatgtaatgtgttctgtgggtgaattactccctcatcccaatatttataaattcactcatttagctaagtgtttatgcctggccttaaataatttagtacacttgaaccctcttataaccctgctcctccctgcattaacttgaatacttctaaggtaagactgaaccccaccatgactctacacagaaattgttcctaaaagataccagcgttagaaggagttgaattttatttattggatacatacatatatgtataatatataatacacatatgtgtattatacattatcatacatatatgtattatatattacacatatatgtataatatataatacacatatgtattatatataatacatatatgtataatatatgtgtttcatatgtatgtatttgtttaattttgtatacagattaggagaagcagtttttgttttgtttttcctttaggaaatcatattccctaattggaatgggaaagaggaaagaaccataagctggagcttacttccttttctaccgacaaggaacccaaacttcaaaacttatttgtcaacataaaaaagacaataataaaaacaacaactttagaacgttcaggacaaagccttcaaagccttcaatgccctgaagcaggttttagaatggctgtcctctcaaattgctttttcaagtgtactgacccgcactttgtcttcagtcacacctaagttttcggcaagttcccttctgtggagagaagatcacacatggttagtattcaaagttgtggatgaaatgaaatatatagtatgtactatttacttcatgcttgttttacaatttataatctcccctcacacctcccccaagtatatacttttctctaattcccagctccatggttgctttagaaatggtttaccctcatcacgaaatttaaggtgacgttaacaactcagtaatcaagagaaatacctttttttttttaaattgagacaaggtctcactctgtctcctaggctggagtgcagtggtgtgatttcagctcactgcaacctccgcctccggggttcagacgattctcgtgcctcagcctcccgagtagctgcgattacaggcacataccaccatgcccagttgatttttgtatttttagtagagatggggttttgccatgttggccaggctggtctcgaactcctgcccgtctcagcctcccaaagtgctgggatttggggcatgaaccaccgcacccggccaagatgaataatttaatgcattattattatttttattattattatttgagacagggtctcactgtcgtctatgttggagtgcagtggcaggatcactgctcactgcagcctgcatgtcctgggctcgaacgatcctcctgcctcagccttccaagtggctgggagtacaggcacacaccaccacacccacatggctaattttttaagttttatttagagacggggttttgccatgttgcccaggctgttcttgaactcctggactcaagcaaccttcccaccttggcctcccaaaagcgctggaattacaggcctgagccaccgtgcctggccctaatgcactattttaataaataacaattaatgcaaaaatctgtgatgaggaccaggcactgtggctcaggcctgtaatcccagcagtttgggaggccgaggcaggcaaattgcttgagcccaggagtttgagactagcctgggcaacacggcgaaaccttatctctacacacaaaaaaaatacaaaaattagccaggtgtggtggcctgtgcctgcagtcccagctactcagggggctgacacgggaggatggcttgaacccaggaagcaaatgttgcagagagctgaaatcgcactgctgcactccaacctgggccacagagagagactctgtctcaagacaaaacaaaaaaaccagaaaaacaaaaaaccaaccaaacaaacaaaaaaaaactatgatgaacaaattatcaaaattttaaataaaggaaggatctagcactgtagttgcatgacagtacctcattctccttaccccaatttcaataaaattttatttataaaaacagaccacagctgggtgtggtggctcactcctataatcccagcaactcaggaggctgagatgggaggattgcttgggtgacagatcccccactcaacaaaaacaacaacaacaacaaaaacaggccatcatcacaggtaataaaagaaaaaatacataacttggactatatcaaaatttaaaacttctgtatatcaaaagatgcaatgaacagagtaaaaagacaactcatagaatggaaggaaatatttgcaaatcacatctgataaggggttaatatccagagtgtataaagaactcctacaacccaataaccaaaaaaaaagaaagaaagaaagaaaaagccactcagattttaaaatgggtaaaggacttaaagagatatttctccaaagaagatatacaagtggccactaagcacatgaaaggatgcacaacatcactaatcattagggaaaagcaaatcgaaactacaatgaagtatcacctcacacccattaggatggctatgtaaaaaaccccagaaaataacaagtgttggtgaggatgtggagaaactggaacccccatgtactgttggtgtgcacctgtatctataaaatggaatattatttagccttaaaaaggaaggaaattctaatatatgctgcgatatggatgaaccttgaagaccttatgctaagtgaaataagtcagtgacaaaaatgcaaatactgtatgattctacttacatgagatacctagagtagtcaaaatcatagagacataaaatagtagaatggtggttgccaagggctggggaaagggggaaaaggggagttgcttaactggtatagagacttagcttggcaagatgagaagaattctagagatctattgcacaacaatgtgaacatacttaacacaactgaactctatacttaaaaagtggtttggacggtaaatttcatatttccgtgtattttaccacatctttataaaagggaggcacggactagtttccaggtttcattcacataaacattgcaataaaacatttaccttgatgcccaggaggtaaatatccccctccacaccagcacaaaggcaggcaaggacccccagtggctttttcctcatgattgggtggggcaagggagagaaaaagatgcctcgaaacgaacttggagatctcgtggctcctggagcaggccacttaccttgtgggcacatcagggtattgagtgtgtcggaaaacactttccagctcctccacctgcaacagcgtgaacttcgtgcgccgagttcgtggctgcatgttctcgggctgcggaccctccatggccgcctgggccggctcctccggcgggggctgcggctgctgccgaggctcctggtttccaccgccgccctcggggatcatgccgccatcgcggttcatgccgttctcgtggttcacaccgccctcagggttcatattacccatgaggcctggagctccttggccaacatggccttctgcgcttgatgctgcccccagctgaggtgtggggcttatttttacctggtatacactcaggcagtagaacacggtgtcgtggacgagcgaacgcgccatggctggagcgctgcgcccctgcacaaactccgtggcgtctgcagctggagtgggggttagagggtggagctagttcctgttctcatgcttggtattggttacagttgcaatgagtgggacttgcttatgcgcacaagcaagagagggaatggagaggagtggggggatgggaagttggggggtgcgggtggggagtgggggtgttgcaggtgggagtggggggttgtgagtgtggggtggggtgcaggtggggatgggggtgtgggtggagggtggggggtgcacagtgagggtgggggttgcgggtgagggtaggggttgtgggttggggtgggggttgccggtgggggtacatggtgggggtgggggtagcgggtggagatgggaggtgtgggtggagggtgcgtggtgggggtaggggttgtgggtgggggtgaggggtgtggtatgggtcgtgggtgggggtggcagttgagggtggagtggggtggccaaaacacaggggcagtgtggagaagaaaagggccaataggaggcatatatgtatgcaacatggggccccagcttgcagctttgctgactacaccctactcgggcctagttattaccctgaggaaagctgatttgggggctcagaggggaggtgagatctcacggtgaccataggacgccttgagtaaaagtttggagaatatctcatggcctgaccctccatatttggcagcatgcacagggcgcgggctattaattaagcagaaatgattgactgggggctgcttgttcagagttccagcaaaggcactgaaagcagagctgccatgctctcttcagtgctgggatcgggatcttggagatgggcatgcagagcattctgggtggtaagatgtgctctgcaagaaatctaacgcaccctttgagaaagtcaacacagaataaacacgaggctgaatctgttagcctgagactgaatatctttggctatgcaagagaaacctgtactcatggcaaaatggagtgctataaggacaagcaaaaaataaataaataaataaaatcggggatggtataggaagagcaccagtaagggcatacctgccaaaaatctccaatcttgggatggagatttgggatttatggatatgcagcttactggatgtggggccacttctgctccacagagccttgtaactacacagccttcctaccactgaccccaataagcccaattacgaagaaaaaccctgaagagcctggtgcagtggctcctgcactagtcccagctactcaggaggctgagatgggaggatcacttgaacccaggagtttgaggctgtggtgagctagaatcacatggcagcactccagcctgggcaacagacagaggccccttttctttaaaataaataataaaataagaaataaaatgaaaatgaaagaaaggaaagcgctaagagagtctgtcatgaggaagggcatggagatgtcttttgagggtggacaactcatgaatccttaatttttctagagattgtgtgtgtgctcttaagtgatgttatatactttattttgttttttaaaaatatttttaaaaattttatttttaaatgttcttttaaaaactttctgtatctatttatatctattggttatttgaggattttttggcagcatatataaatatgcagaccctttgagtctgtagcctaccaagagagatagctctcgtcttcatggtgattctgagcatggaaaggcccttgcacttggcagcatgacaaggactaagccactcgctccattaattgactgccatccactgggctaagtgagatccttgcgttctatccctagtgagagaagagagaggaagaagaagaaaaatagaaagataataagaaaatagaaaaagaaatgaataaatgtacattgtggggagcaggaaaggactaccagtaatgggaggcatcagctaggagcacagatccgaagcatgactcactgtgtgtcctaggacactggatgaatctatctggttctcagcttcctcacctataaaatggagataacaacagtgtctcgatcatagggttttcatgagagttcaatgaggcaaggcatacatgtaactgaacacagctccgactgctcaccagttgcaaagtccagtgaacaagaacgacgtctggtagaaagaaagtggctttattccagagctagttgaggggaagtagtacaggctgccttgaggaagccactaaagcctttggggcagaaggcaggagctttgaaagtggggcttggcgtgaatggcatgcaggggagagggcgatgaagtgcagagtctatgtgacttgcttcggatgtcttatctatcaggtggtctggctggcaccgtcacgggcagagctaggttgtaagttgaggcaatctcaatttgcctcctggtaggagagagttctggaggttcctggtttgctttaaggttcggtctctgtaacttctaagtaaacatgtagttagataagcttgctgtgtagggagtgtctggtggagagaaggtaaagtttataattgcattcccaaagagctaagtaggaggtgtgaggaaaggaaaaaggaaaaaataattcatttgattctttaaaaaagaggtacttggttatatatagactgttttattctttttcttcaactccaaatagtcaatttatcagcaaatcctgttgactccgcctcagaaacacattcccaaacctttaattttttttctctgacatgcttaagataatctctatcatcttaaacctgggatattgcattagtgtcctgtctccctgctttcaccttttttctcctataaacattctccacccagcagccagagtgatctgatgatgaaaatgtgaattacaccatggtgcccctgcttatcaccttcatactgcttgttcttgggttgggtccagagtaggtacttaatacatggtaatgcttattacattattatttgctctggtatctaggaataagatatattaggccaaggaagaaaatctgtctgctgagtgaaagacacactctcctggcacatttcctggcccagggctcatacatgcagcaaccaacataggcttattgatggaagcacatataggtacatagaaacatggtacgtgtattgttttcacaagaagatgctctatctttattacatgctgccagaggagaacaatcactctctctcccttgtgaataaaaaaatatgaaagtgagtcaagtaggaaatgtgaggctgcatggtcatttgtgaaattgtataattaagcacctcaattaatcctcaaaacacctctatgaattaggtatgattgttatctccatttaaaaaattattaaaccaaggcaaaatgagaataaactgctcaccagattagccagctagcaagtagtgagtgaagccatgattcagatacctagtctggttctagggtcactgctcacataaatctgttacatcaggccgtgatttgtggctatttttgcttaggatgagggttccattaggtacttaaggttttcaagagtgaatcaaaaattaaaaattaaattatatttaaagtaaaacatttaagtaagtactagcttttctggtgcccacatagggcaacaacactcacctaagatgcctatgagtgactgaaggtgagaaaacaccggggtacactgtggaaatctgagatgtggaagaaatcaagctgtcacagacgtcccagctagtctactgcactccatgattaaaactcttacatgtctctcatgcagcatttgatccaaggctgaaaattgatcatgaactgattagttaagagaaggagagggggccagactccaacaaaagtcagattttggttgaagtcagagagaggttgtgagattgccatcccttgacatctttttaaaagtgaattgtttaatcacttttttttaagctgatttcttagccatcttgcagaaatatgaggcaggggcacttatccattaggtacagtaggtaaggtaactaagcccaatgacacccttagcagcccatgaaaatggtttagtttctttcataaaatggtgctgaagataatgatagttgcaaaggaaaaaatacggtagaccaatatcatagtatgttaccaagcatagggcctattattggaagctatttccagtgctcaggatattaacatctcctggagcgtctgcaaaacacatcttgaaggcagaaccatagtcctcaatttggcctgcctcttttatttgacaataaagttttatttatttctgagcataagattgggattttatttctagaaaaagggagaaaaggtggaaggaggaggaggcagggaaaaggtggaaacttgcccaggcccatagcaggagcccaacacagggaacacttaagcttgtgtagagtacttgtaaccagaagcccggaggtggagcacagcagaggatgcaatgtgccactgtcgcggccagagcccatgcagtgtaaacattaacattcttggatgcactaagcactgggctgcggtctacacttgcattctgaggtggtggagtcatggccaaaattttggagtacttggacttttctcaagaagcgttgcacttcttgtccggaccggggattaccgcagatcgcagcccagagtctgcggaggcgcaccgtttcatcaacagcagggactgaaacttcagcccaggagaagccaagatggcaccgttatcgcaccctgggaatcgaggaccgggaagaacttaatggtcagtgcctggatggtgacaggtgctccagtgaactcaggcaaactaccttttcctgcgacagccgattatctttgtgcagctttcagtttgcggcccctaacctcctccagcccataaactcaggcctccagtgttctgatctttctctttgcctttccgcctttccagatgcgattcctcccgtgatctcagtgattgtatcaggcgaaaacgaggagggcaaaataccgtccagatgtaaactaggagcagccgcaccagcagcaccagcagaatgccgtggtagtgcggcaggccctggccccatggacaaagagaaactcgtcagtggcagtggccacgaactcagaaagcctgaggacagtcagcagctcctctggctcttcactttcacactggtgcaactacaggagctgaagaacatttttcaactcgttccatacccggacgtgttaggtaagtggcatgcttaggcggcaccgacttttcacggagcaggggctgggctcagggcttattctctttccccaggccccttccaaacctttctgagccaaaagctacctaggggtttcaaggctgctggggcctgtttgcccttgggcttcagggtggaggcaatgcctcctggacaccaaggtaaatattttcaagcaacatttaaatgaatcaagtggggaaactttggcctgataactaggtttgtataaatagaatttgattggaacaagaaccatgatcagggtgaggagagtaaggcatggtcgtgcaagtggatgggcaaattctggttttatgtaaatatttgataatttgctcataatatttttgatttttcagagtagtgcaaaaagtgttatttttctggaatcctgagtttttttgtgcccccttacattcactatgggggaaaatcattcctaaagaaagcctcaatctggatattacaaaatagtgtactcggggagaggtgttgggaggtaagtatttaaaagcaagcttgaaatgaacaacataaattttgtttcatccacaactctaaatactgaatctttgtggttttctctcaccagaaagggacttgtaagatgcatgagcatgactgaaaccagtgtgcaggtcactatacctgaaaaaacttatttggcagggcagccattctacaatctgcttcaagaggtagataccattgccctagatattctgaagttggtgtgtttttgttgccttttccaggtttgcgaaataagttcaaactgtgagtttttgcgaatagaaaatgggataagaaaacctcagcttagggaaatttcccattatcagagcatacacgatttcaaaaaaggccaaagaaagtagaaccaaactacttttctagttcctatatattaatacaattaaatatgtatgtgaataatatcagtatgaagtatctaaatatgttatattgtatataaatataaataaataatatgcagtatatgtgtttgtatgtatgtgtgtatatatatacacacaaatacatatgtgtatatatattagggaggacatctatgtgaagattatcgataagatgggaataaaagcattgtctatgccatagaattgagaagaggaataaatgacaatatatgtaagtacctagcacaatacctagtcacagagtaagacctcagaaatatttgttactattactctgtaatatatcctctcaccacagtataacccatggaatatgtgacataacagaataagcctggttaggagtcacacatttggttcttttggagatacacactgaaatatttactgatgaaatgatgtgacgtctagatgtgcatcacaaaaatccagggggagatccaagtgtgtttgagaattggttagggtattcatgaaacaaggttgtctatgataattgttgaaactggataatgggtacaaatagggttcatctttaccattctctctgcttttgtatatgtctgacagtttgcataatagaaaaattgtaataatcagagttgtaaattcaaatgttgacaaggccagacaggtaacataaaagagagaagcaagcagggtagggactgtggcaaactgggaaagaatatgtctcttccaaaggggcagccagtattcagctccagcttagtgttgctggctggcaatgttgggccaggactgccagatttttcagtttttcaagattggccacaaattataatgttgatatgaaaccttcagttctttaaatgttggtaactaactgaaatatgttttattgaaaagtatgctggccatctaaatcaggtctgcagaacagactcaggctggagctgctagtttgtaaactctgcctgagaagccaattttaagcaattttcattctctggagcagtagaatataattgacagcgtttctaaagccaacaatccaagaatgccattgtgctgtcctgctgttccttattgtaagtcccgtgcccatatatgctttgctctctgccttccatccctacctgaagtttctctaactttatctttcattctctttacttggttctgatcttaaggttcagagcactgatgaccaagacttcacaagtgtccaagagaggagacctcacagtaatgaattaggcaccagctcacctgatctttctctctggtacattttgcagctgttcttaacaatatgcaggtcctttggacagttttcagaaatattatgcctcaaggggcaaggcaccaggctggaagggcagggcacccttgagaagaaaaagggaattttataaaactagtatcaatttgtgatcaagtagaacttcctgaagttcagcagttctttcaatctccctttttttctttttcttctcttatattgaagtaaaatttaaaatttaatactttttattttttaaaagcatgtatggcatcatttcagtcttattaaattctctctgcatccattcacccatccttctttttgtgtgtgtgtgtagtggtctctgtgagagggttcattaatgtcaatcctgatcatttcttcctcaagagatgtcagtagatttgtttttttttgctttggacttttatgaattgattgaatttttatgccaattatttttaaagtattacatagaagaacaaatggacagaaaaatttaaatgcaatcaaatcttgttgattttgaagtataggaaataatcttttttttattatactttaagttttagggtacatgtgcacaatgtgcaggtttgttacatatgtatacgtgtgccatgttggtgtgctgcacccattaactcgtcatttaacttaggtatacctcctaatgctatccctcccccctccccccaccccacaacaggccccagtgtgtgatgttccccttctgcattgtcaggtaaactgcaggacactcacttgtatttgaatttcaaataagcaacaaatatttttgtataaagtatgtcccaaatattgcatgagacacagttatctaaaaatatttgttgtttatcagtagtttgactcagcactccgtatttttattgcaactctcatataaacatgtcattttcataggaaatgctttaaatactttgtcctttttttctcatccattcatcccatttatatttttcttttaatttaggagattaaggaaaacattaggtactttgatttgagccatccctataattatacacatgcatatgttatatacactcatatatatattatctatatacagatatatgtgacagtgtgctctatataatacctgatgtaaacacacacgaaacacaaactgaactgactgtattgttgaaacagctgctcagtgaaatacgtcttgtgacctgtggtccttctgaaaccgacccaacagttctatagaccagtggtccccagccttatcagcaccagggactggtttcgtggaagacaatttttccatggacttggtgggcggggcaatggttttgggatgaaactgttccacctcagatcgtcaggcattagttagattctcataaggagcacgcaacctagatcccttgcatgtgcagtttacagtagggttcgcgctcctatgacaataaaacgccaccgctgatccaacaggaggcagagctcaggcggtagtgctcgttcacctaccactcacctcctgctgtgcagcccatttactaacaggcaacagaccagtactgctctgtggcccaggggttggggaaccctgccaaggactgttcattttgataaaaatagaaatggacccttctggtgttaaagtttgaaccttacatttgttttatctgagttccttcctcaggaagcaaccttcaggcctctcaaaaaaaagggatcaaagaactgaaactcaccagatcactacatccagacagtgagatgctagacccctctttcatcttgattgcttccttgcccctccctagttcctgttttcttatacattgttaaatttcttccctgctatataaacccgtagttttagtgggttcgggggatggatttgagactgagcttccatctcagctgcagcatccgattatagcctttttccttggcaatactcactgtctctgtgattggctttctgtgcagtgagcagcaggacttagacggtagccttggtgttttggtaacacttccttcagtcgtttcggaatgaggcagagaaaggacaaggtctcctgtttagcttagacttgaatgtcatgtggaactggaaggagacagggacccagttgccctactggcttttttctttatccccttatcccacagcagcagtgaggtatctgggagtccttgggctctggaggaaatgtcaaagttgttggaaaagccccaagcccagcaaatctgcccactccctgcaggactgctgctttcactttcactcttgcccatggcctagggactggaatggcctcagccatcagctgggtggcctctgccaaggctcttgaaaccagtcctaccgctcacactagtggtcgtgctttctagggtggccctctgccccacatggcatccccttagcttctgtcttctggtccgccaattatggcagctacccacacccctatgggtatgacaagctgtggcctagcctcctcaataaggagagggaggagagcctgtggcagaagtgagtgagctcacctgcctgcagagtccctgacatcttacttctgtctattcacatttcctctctgcctgccttgtgttttcaccctttcaatccatctagctgatggatcccttatgcatcctacctactcccttacattcttactcttcatcacgtcccttcataagttgccctggtctccttcttctccctttcaccttctgctggagcacacatggccaaacacctcatactcactggaatttccttgtcttgtgttatcattaaagaaaattatatataatatatatgttatatattatatatgttaatatattaatatatattgtatataatatatatattatgtaataaaaattgtattttttagtgatgaagtctcgctaccttgcccaagctggtctggaactcctggcctcaagcgatcttctcacctcagcctcccaagtagctgggattagagagcatgtttttattccccactacactgagctcctggaaggaaggacctctgttttattcatcccagaattctagtgctgacaaagattctcttattgaccgaattttactcaggttcccttgagctctttttcaactaggcctggagttttggatttctgagtttgtctctgcattgtccgatttcagcaaggaaattgctaagtcctgctaagtctatttagtcatcccccatatccaagcactctcaatatctaatctggttcctcatcctccaccatctcccaggtgatgtttgatcgccctggtgccttcagcaaaaataatgttaggtcggtttggcccaaatcttccattatgcctgatgtttcctcttagttaatttccatccattgactcccaccttgttccttggctctaaattcccacttgcccacattgtattttagctgatctcaatctatctcccccattgcaagatgccattgcagtgattcctatacttatcttgatatttcccccttgaacacagtctttctcaccatctttaacaagtgtcatttaaaaaaattgaacagtaatgatgctgtgacttttataggatcagattcatcattggactcctggacctatcactgcggacctcaaatgtgcaccttttaagccctttccttcactcctgactgattgatttgggatccactgctaagtcagacttttgaaccattgttccaggcaaacttctgttaaagctggtaaggattgatttgattcttaagattctgagtatactctctgaagcaggttagagttccaggcttgttttgaaaggtatctcctaggctggatggtttccttcctggatctctgtcttgagtggggattattctctggctccctgggctgaaagcttttctttctggctttctattttgagtgggaattattcattgattctttgggctggaaaattttttttttgagacagggtcttcctttgttgcccaggctggagcgcagtggtgtgatcatggctcactgcagcctcaacctcccaggctcaagcaatcctcccacctcagcacccctgagtagctgggagtacaggcacacgccactgtgcccggctaattttaatctttttttttttttttttttttgtagagacagagtctcactatgttgcccaggctggaaattttttccttgttactttgtgaggcctctctgttctatttgatcctgtttttcccacaggaacttctgagtcaactgaaacaccattcttgaattcctactgactatatgctccacctacactgtccaactccttcttgttgacatggttttgctgaggataatttggaacttcactggtctttttgggaaacttatcatctccccaaactggtgtctctaagacttctctcttcccactggtttctctcctccttcctcctcttactgtaaccaaacgcaggctaagctgctcattgcttgcaaaattgaataacaaggacgagggtggtaaaaagaaagtgacttttattccagagcttagcagtggggaaacagaacaggctcctgccttaagggaactgatttaactttcagggaagaaagcaagggcttaaaaagggaaagttggtgtgaagggcaaggaggtgcggggtctacgtgactcgcttggatgacttatattgagtgatgccatctgatggtctggtctgcaccatcatggatagaattggattgtgaattaattgttgtcttgagacaatctcctggtggggaattccagagagtgcctgttttgttttgagatttggtccctgatacttctaagcaaacatatatttagataagctttcagtctaggtgttactggtggagggtgtccaggttcttggcgttttgaacaaagaattggacaaaatgcacaaaaaaagcaagtaaagagtgaagcaacaaaagcagagatttactgaaatcgaaagtacactccacagggtggcagcaggcctgagcagcggctcaagggcccagatacagaatcttcttgggtccaaataccccctagaggtttcccattggccacttggtgcttacctcacgtaaatgaagtggtggcccgcaatcagtctgaatggttgcggaaagcaaccaatcagaggctgaagtgaacttacaaaggtcacattcctatgcaaacatctggtggttgcagaaagcaaccaatcagaggctgaagtgaacttacaaaggtcacattcctatgcaaacatctggtggttgcagaaagcaaccaatcagaggctaaagtgaagtcaaaaagttgtacttctatgcaaacggtgacctggctggcaatcaatcagattgagctgaactaaagttataaagttacactcctatataaaggtctgattggttgccaaaatcagccaatcagaggtactttcaatttcccatctgcagcaaaggaaaggtgggggtttgcaaagggagtagcctctggtccttttgttacttaggtgtggaaagttagggctttcctttcaatttagttctaggaagttagtgtgaaacagctttaggttccctgcctccagaccctattctcctgcttcacagggagtgtctgttggaaagaaggtaaagtttataattgtattcctaaagagtaaagtaagaggtgagggaaaaagaaaaaaaggtaaaaataattctttttaagaaaatgaggtacttggttacgactccccactgtcaaattccattccattttcatgggatttgggcattgtttttattctggctacttactgctgaaagtgggaggagttatagggtaccagaatggaactgatccattggagttggaaatattcacaagtactggggttcacagacaatgtttgctggagcattatggtgcgaggccaggaaagtctcttgggaaagcctgtcttgcatttccatacagaagttgcaacagcagtaaaatccacagcaaagaaatatgcctatccctgcaaccagggccaaagttataagcagcttttgccaccaggacggtcctgacctgaaccaggttgctaaccactgagctagcgacaatgtggggtcagacatagttttgatttgttggttcatgtcttgcagggctaacaagacattttctgaattatctgagataatatttagcattcagtcttaattacttaattatcatgcacagtccccactatcaattgtgtccagagttcttgtggggatatgatgacaggtggactcaatacacaaatttaacagtttttttttagtttatatttcccacatcttttggttaagacatacaggagaggtcataaatgtttatgaaggcagtcttgacacatgtgtatggaacaaatatgtatgtaacatatgactcatgtttatttttgtgtggggacttaacatataatgtattataattaggccctagacatcaaaaggtctttttaggacataaaggcatgcaaatgtgtactttttgtaaactagccagaattagcctatggtcagtggtcttgtttatagtttggtatcttattgttacaaagaatctgtcttatcagtcttatgatctccattttaatgttaatgcttgtcagttttgcctaaattccagaaagggtggggatggtgtagtgaggcatgcctgatgccctgctgtctgtcatggcctgaaactttttcttttaggtttctttgggattcccttcgggcaagaagggagtccatttagttggttggggtttaggattttattttttttagtttatattccccactgcttttggttaagacataccagaggcagcattgatggctaaactttaattttgtcccgtgttgttgccagggtggtgtgtgtccattatgtcccttggtaggacccctatggccaagggacgacccctatggccaagggattagagccaaaagatttataggcaattaaacattctaggcccgatgggaatggaggtaagcaggcacccattaacctttaaaatcactttcaagtaacataagagcatacattttatgcattgagctattctaattttggcttgtagcaattaggtatataaaacacaagcattttgtttagtggcttaggcatctgtgtgcccgtcctcaatttggagggtctgaattggttttatacctcaaaactagcccttataatctcatatgcccaccgcttgcacaatagtccctgggtttggaacgactgaatagttttacgctctggaggcaaaacaaagataaagaattagcagtgttacaaacaaaaaagttaaaagccctgtctagttttgagaagggtaagtttataggtagctaaacatttaaatcatttagtattaaggcatagaataaattatattattccagatagaggcaaaattattaaatgaatcttaatgtttctgaggacagacctttccctgtgtctcatgaaagcagtttattttgattgttgcctttgcctgagtctaaagagaagactttggttaacttgagtctggtgtcagatactggcaggagtcagtgtcttctttagatgagatatgtgtatccaggagtcaaagccctataacttaacaacacaaagattagttaatagagatgcaagatattttcttgaccccttcattggatttgcaacaggggtgccccatttactcagcccaccccactcaacccctcgtaggagggaatgtgtgagtgaatgagtgcaggagccggaataagcaagtgcaggaactggctggctgctttggtgccagcaggagcaaactttgtgcaggccctgtggcattgtccaggtgggggtgcctccaaccccaaggccccagaaggcatgttatgatgctgtcttagctccaccatcctcagacagcagtgtgttattagttcagtgggccttttgcctcatcacatggggcagcttccctctgccagtgagggtaaagggccagtgtgacaacctttttggctacctgcacttggtgagtcccaaattcttgtccagtgccaaagaggaatgaggtcatgcagatgaattgaaagatggtgaatgtagagaattttattgactgatgaaagtggctttcagtggagaggggagctggaaaggcgacagtaagggcaggtcgttctaccctgaaatcaagctgcctctctgcctctctcttccaaagtcaagttgcctctttccgatgtccacccactgtctctgaagtcaagtcatctctccctgacatccagccgcttctcctctctatcggctgaatctggggtctttatagacacaggatgggaggcagaatgggcctaggtagttttggaaaaggcaatattcgattgggaaaaatacattattcaggaagaaccaattgggagagagtgggcacacaggaatagaagttctcactttgggctgtgtgtttcaggctttttggctcaaaggtggggttttaccatggacccctcccatctgcctagaatttctctgcctcctgtcgctatcaatagcacctgatgaggacttctaaggggttggaggtggtaatactggagtttatgacctgattggaagctgtaaaaagattttataaccttatagttatatatataactttgatatatatatcaatttgatatatatatcaaatttttataactttgataaacctcagcagtaagtttgagacttaatttaggatttgattttgaggacatctgtcaaagaggctaaaaggcttaaaattgatcaaaacagaaccataggtccttgtaaaacaaaagttgctaatgtatccaagatgataactaagagattttaaaggcaaggtggaaggttacatgtatataaaaacttaaatccttttaaatctcagttttttaattaatcaaaaacttaataaactttattaagacaacataggaactatcttgataaaatgtaaaatcttgtttcttaagccagttatcaaaaaggcaaaaaaaccccaccccttctttagtgtgactgtatttttaaattagaaagcccatttagataatctgaaagtcaaactagatgaaaaaagtacttaactttaatcgtacacgggaagactgtgtttaaggtaatgagtatagccagggaatacatgactctgactaaatgcatgagaaattttcagattacattgaaaatttggacatattaaggaaagacaagagtgcagagtcaagttatcctagaggaaaacattacttttctagacctttaagagcaaacattttagcattaggccacaacagcagttagaactggaagaaaaatgttataggagttgataaaaaagctaaaggagagagttgttaccttgggccctctcaaggggaaaaaaagctgaatgtagtgagatacatcaaaagttgaacttctgagatatgattccaagaagtttttaaaagaaataggctatagaattaaaattaataatcttttgcaattttatttttttaaattctgagtccttttcccttttctaccttttgtaattttattaagagtaaatcaataccttaagaaaactttgttttaccataggtgaccaatctttagaaagactattataaataattcctttttaattatagcccaacttaattatatataaaatttctttcataaattcctcttcacaaactttatcatgacttacatagattatctataacatgcttggactatttgacttgtcctaaatttttctcttttctaaataaccagtcactttattttaggatgaagatcttatttcatataaaaattattttattttctttataccatttttaaattaaagatatatttttatatccataactttttcatacctgtctcctatttattgcctttttcttttttaaaaaaataactaaaaaaaccctctacattatataaaattatttttaaactaggaatataacttatataatacttattaactagaattcttattcttagcgaccgtaaattttagtgaaaacctaggaagcaagaaattatgaacaatttaacagataatagtattttatagaggaaaccattccataattttattttaattaattaactaactaattaattaattttttgagacatggattcactctattgcccaggctggagggcagtggtgtgatcttggttcactgcaacctccatttcccaggctcaagcaattctcgtgcctcagcctcccaggtagttgggattacagtcatgtactaccatgcccggctaattttttattttctgtagaggtgggtgtttgtcatgttggctaggctggtcttgaactcctggcctcaagtaatctgcccatcttgacctcccagagtgctaggattacaggtgtaagccattgtgcccggcctccatgattttagaaacacgtttttctttacttaattttttcttaattagaaatggcccagacatccaacaagcaattattacttaatttaaaaatttcaggattttaaaatatatgaaaactctatttacaagcatttattttttatttatttgagatggagtcttactctgtcacccaggctggagtgcagtggagtgatctcagctcactgcaacctccatcttccaggttccagtgattctcctgcctcagcctcccaagtagctaggactacaggcatgcaccaccatgcctggctaattttttttgtatttttagtagagatggggtttcaccatgttggtcaggctggtctcaaacacctggcctcaagtgatcagcctaccttggcctcccaaagtgctgggattacaggtgtgagccactgcacctggcctgcaagcatttattttatttacatgtttaaattttaaacttttgacagtttatctagattacttatgaaaactgagatattacacaaaggtaatcattatttagagttagttccctgttaaccatttttaaagtctgtacacattaggtgtttatttaagtaagaaccttaaagttaaacatatgggcattttgttgataatttagaagatttaattttttattaaactaacaatattatattagtcttatttattaaaaaaatcacacaaagatttttttttggtgggtttataggcttatgacatttatgttaaagcctaatacttttatttatagacagtgacaaatataaaccatttggtcaataaactcagacaaaaatgtgtgctgacaattctgaaggtatttctatttttatttcaccaataatcttaagatcagttttatttatcaaagattactaaattcatgtgaacttaaaaagcattttttgtagaggtgggtgtttgtcatgttggctaggctggtcttgaactcctggcctcaagtaatctgcccatcttggcagattgtactcatttacttataatccttttggtagcatgctagatacaatatataatacatgtacatacacatgaacagatctaaacatgtatacgcacacaaacaaaggtcccaatagcttttacctcagaattctagccatcagataacaatacaaactcacaactttatgaaagatagctggatccacattattctttgattacattggaagctgtttatatggctaaattttgattgcccccaatatataatccaatgaaagctgtgaaccaaaatttgggtaaagcagtctctgtggcagtttgaaaaatatatatatatatatatatatatatatataacctcttctatcttttttttttcagtttcagatgagtttccaatgtttatattctagttggaccacaaataacgagtctcatctcagcacccgaaggttagtaatagatttcaagcaggcagaatagaaattagaggaagatggagagctttaaaacactctgcttaactttctagttgcaggttaccactcgagctctgaatttttcttgctgtaattttctcatcatttaaaaatgtgcacaaaaatacgtcataatatgtaaccagctgtaattccaaagagaattaaaatatgaagttcctggcaggcttctgtgaaggagctgggttttaaaggagagaaagagaaagagaaggaaagagaaggaggtttgtgacccttccagcccctgcatggtgtgggtttggtacccccaccactctcatttacctcctgtcagggagagcccaagtaccctagacctgcacaatgtaggatgaatccctccccactccgcaagtcactggttgaagtgaactgtttccagctggagggagctaaagatacatttgcctgagagaagtaacgatgtaggtggctttgcaagataaatcaggaagatgaagtcgtaagtgaaaaggaaaggatgaaatcaggatccacacacaaaggtcaaacactcacacttacaaacaaatggtgcacttctgaacaaaaccctggttaaggggctaggtaaaatcctgaatgccttacctcagttccaaacagctccacaggcagctaagtccaaatggtgccaaagccccaatggtgccacatatacaaatgtgttaaacgccaaaatggtgccaccggcagccaagtctaaacagagcagatccccagcaacactgtagaagacacagaggaaagtcgagtccactccaagtcactcacccagtttcaaaggttgccaaatttcttcagaggtcacattctttataccagcaaggcattgaaggcagcagacatcatgcaggaaagagaaagggaggttacctgaaaagaaagcatttcggcagcttctgggaaataccctaatgttcttacaacaagcagttgtaagaacttgcttaccaacaagcagttggtgttcacaggtggccctgtgccctgcccagtagtgtaaactgggctagtaggctcggacagccagaaatgcacagtgctccctgtatgggccaccaaatgtttaaccaaacacagatttggccgctcagcgcttgcaaaatcaaatagcaaggacgagggtggtaaaaagaaagtgatttattctaggcctggcatggtggctcacgcctgtattcccagcacttcaggaggttgaagcaggcaggtcacttgaggccaggagttcgagaccagcctggccaacatgacaaaaccctgtctctgctaaaaatacaaaaaattatccaggcgtggtggtgcacgcctgtagtcccaggtactcgggaggctgaggccggagaattgcttgagcctgggaggcggaggttgctgtgagctgagattgcaccactgccctccagcctgggtgacagagtgagactccatcttaaaaaaaagaaaagagaaagaatgaaaaaaggaaaggaaagagagaaaaaaagaaaggaaagggagaaagaaagaaagaaagagaaagaaaaagaaaagaaactgacttattccagagcttagcagtggagaagcagaagaggctcctgccttaagggatccactttaacctttgggatagaaaacaagggtttaaaaaggggaacttggagtgaatggcatgcaagaggggtgactaggtgtgggatctatgtgactcgctccaatgcttaccttaagtgatgctgtggtctgatggtctggtcagtgccttcgtggacagaagtgggttgttaattaattgctgttttgaggcagtctcccggtgggggagaattccagagggtgctttgtttgttttgagatttggtccctggaacttctaagcaaaaacatagttagataagcttgcagtgcagggagtgcctgttcaaaagaaggtaaagattttaattgtattcctaaagagctaagtaagaggcgagggaaaaagaaaaaaaggtaaaaataattccttttaagaaaatggggcacttggtttcattgctaccttcaatcttctcttcagctgccttgaatgctttaatatgtccctggcaaactcctacctcttccattcctctgtccactcctgccagacttccctttccattttgacccctcaacttcccagtctctttacctttaggttgcttgaccccattaggggctctcaagggacttagtgaccccaaaggcaactacctgaagctcaaaaggaaaaaggataattagaaatagactgaatattttatccactcagatgtgttttggagataatcaaacagccgctagatgtctccttagtctcttgcctaaaatagtatccacggacttcataagattacatatcagggtaaaagaaaatcttaaaagtcttctctacaaatattgatttaaaaaaggctttagcctttattcagtaggtaaccttgtcccatttttgtcagaaatgtaattcggataaaaatataaagaagatatgaatcaatgagttttgtattaatgattcatggctaaaagtttagaatgaaaccaagatctccgtttatgcctgtgtctatgtttatgtatgaatgtatgttatgtatatgtgatttttttccacctctggatggtattaactaatgaatttataaaatctcttaaaggagctctattcaaattggcctaaagataaatgaacacttatctcaatggaatattcctaaaactcccagtgatatagaaagaaacccaaatgcttttcaagttcacatgacttggttaaatctttggtaaataaagttagtttaatatttttggtttaataaaaacagctgtcttctgagttgtcagtttcaagtataatatgggcatatatttttattctatttgggtttactcatttaataaactaatattatgtctggcagatgtttaaggttataaacattataaattcaagctaatggctgggtgcggtgtttcacacctgtaattccaccactttaagaggccaaggtgggtggattacgtgaggtcaggagtttgataccatctggccaacatggtgaaaacccatctctactaaaaataaaataaaataaaaaatagccaggcatggtggcatacgcctataatcccaactactcaggaggttgaggcatgagaattgcttgaatccaggaggcggaggttgcagtgagctgagaaggtgccactgcactccagcctgggggacagagtgggactgtgtctgaaataataataataataataataataataataataatgataataataataataataaatataatccaaactaacaacaaatgtacaagtaaagatgcaggtaaaactgaattgtccgattccattacgtcatgtgtgtcaagcacagcagtaaaacaacaaactcatgcatttaactttttaggtttttgcttttgtgatgccagtcaaacatggacatcctgtaaaaatagttaatagggaaataacttcaaatgatggctagctttgtttaatgttatgtttgcctaaaataagaacctagatcttttctaagtaagataaaccacttaaacactaattactgaacctaagttttaagtttatatg[136 bp omitted]gcctcccgagtagctgggactacaggtgcgtgccaccatgcctggctaattttttgtatttttagtagagatggggtttcactgtgttagccaggatggtctcagtctcctgacctcatgatctacctgccttggcctcccaaagtgttgggattacaggcatgagccaccgtgcccggcctggtgttttatttttatatgatatagtgaagctaaatacatctggttctgttaatgaacatgaaaaattatacaatgaggaagcatattcctctagaaattgtgaaactgtgtgttcataaatttgctaatctgctacagaacactagtatatgacagtgctatagactcaatgtttgtgtccccgccaaattcatacgttgaaatcctaacccctaatgtgattgtattagaaagtggggcctttggtaggttattaggtcatgagggtagagtcttcacaaatgggattagtgtccttaagcattctctgcctgtttctattatgtaaatacatgtaaagccctgataaatttccccaaatgtcattgttacaaacctatttatatctttactacagagcatatcgtgggaaaattttttatttgaaatcacacggttaagagttcagaattggttagaagagtagggaatggcttacgctaatatatctacaatgacgtatttgtgttcctgtagtgttaaggataggaagacaatggatattcaacagcagcaacaataatatcaacaattaatctaaagaaacttacaagaaaatatgactaaatatttacccacttttggcatttgagttttgctttcaattatttaaactggatttcctgaagtatttaatttgaaatgtgaatatctgctctcttcaagtgatacctttttcctttgctgtttttaatgtgttttctgtagctgtaataaaccataaacaggtgtctgacagcttttctgagtccagaagcacagaatgctctatgaaagaccatgatccattctctctcctatcaacatgtttttgtttgttctgtaccccatttgttttgtctaggagcaaacacacagagatcttaagcctattaaagttgtgttttggcttagtttcggtacacatatccttttaatacagcagttattaaaaattattttaggcaattagaaagggtaaagagttcttggtggaattttccattaataaaaagcagcccccaaaccatttcttttctaacagaaagcagcctgaaacttcaagctgcaagcatagctatgcaagctagctttcatatgtaaatgccatcagctgtacctggaagccaggtacattcaatatggcgattctcgctcccttttctttgtggccacgtgtgcgggtgtcatggcactagccaggtaaagtcacatgtgcaggtgtcatggtgacagtcagatagaagccataattgcataataaaagattagggttggagggccagtcttttcatggactgtgtaaatggagcacctggtcaaaccaatcccctgggctctatgtaaatcaatcaccgcctcctcaagcctttgtacaaaattgatcacgttctgcacctaacccagaaaccctctctcaggtgacccgctttctcagcatgaggaagcttattctatctctcttcctttttgtctgttaaactttctgctccttaacccactccacgtgtgtgtccatgttgttaatcatcggcgcgagacaactaactacaggtattgccccagaggaagtggtttcactttgaatggtttggcactattgtcaaatatcatacttgttataagtctttgcagattttctatttattcttgagtcagttttggtagtttgtgtgtttgtaggaattgtttttcaatgtattagggcatctaatttgttgaaatacaatgttcatagtattttcttataatcctttttatttctgtcaaatcagtggtaacatcccctcttctttttctaaaaaaataatttcagcttttatttttgattcaggggatacatgtgcaggtttgttacatgagtatattgcatgatgttgaggtttgagatctgaatggtcctgtcatccggatgggatactagtgaacatagtacccaacagttagtttttcaacccttgcccccttccctacctccccccatcagtccctagtgcctattattgccatctttatgtccatgagtacccaatgtttagctaccactataagtgagtacatgcagtatttggtgttctgttcctatgttaattaacttaggataatggcctccagctgcatccttgttgctgcaaaggacatgatttcattctttttatgtctgcacggtatgccacggtgtatgtgtgccacattttctttatccagtccaccattgataggcacctaggttgattccatgtcttcactacagtgaatattgctgtgatgaatatatgagtgaatgtgtctttttggtagaacagtttattttcttttggatgtatgccagtaatgggattgctgggtcaaatgataattctgttttaagttctttgagaattctccaaattgctctccaaagtggctgaactaattgacatttccaccaacagtgtgtaagtgtcctttcttctgcagcctcaccagcatctgttgttttttgatttattaataatagctattctgatgggtgtgagatggtatctcattgtggttttgatttgcatttctctgatgattagtgatattgaacattttttcaaatgtttgttggccacttgtatgtctccttttgaaaagtgtctgttcatgtgttttttgcctgctttttaatggagttacttgttttttatttcttgaattgtttccttatagattctggatagtaggcctttgttggatgcatagtttgtgaatattttctcccattctgtgggttgtctatttactctgtttatagcttcttttgctatgcaaaagtgctttagtttacttgggtcccaattgtcaatttttgtttttgttgcaattgcttttgaggacttactcacaaactctttcttgaggctgatgtccagaatggtgtttcctagattttctagggttcttatagtttgatatcttacatttaaatctttaacccatcttcagttaatttttgtatatgataaaatgtttgtatatgataacccatcttcagataatttttgtatatgatatgtaggggcccagtttcattcttctgcatatagctagttagctatctcagcaccatttactgaatagggagtcctttccccattgcttatttttgtcaagtttgtaagagatcaaatggccataggtgtgcagctttatttctgggctctctattcttttccattggtctatgtgtctggttttttttttttttttttttttttttaccagtattatcccctctttcatttcttattttagtttttgatattccctcttttgttagtctggctaaaagtttgtcaactttgttgatctttcagagaaccacattttggatctgctgatagtttatattgctttcctattctctattttgtttgtctccattctttattatttccttccttctgctagctttggtctagtttcctctcctttgctagtttctaaatgtgtaagttcgattattgattttgcacatttcttcttttttaatgtaggtgtttttaggtatagattttcctctgagcattgtttttgctgcatttcataggttttgggagtttgtgtcttcattttaatgcatctctaagtattttctagtttccctggtgatatcttcttcaatccatttgttgtttaacagcatattatttatttccgcatatttgtgaatttcccagtttcccttctgctattggtttctaatttcatttcatgattgtgaaaagtaaagtagaggttcctcttcaaagactttcctccccatctaattaggaagaaatagtaacttctcttagaagcaaaatttattcaaagacctgggctaacattcttaaatatctgtgagctgtaataaagaaatcaatgtactttatgttcttagcttccacaatttagcctaaatatttgccctggcatgcttatactggtccaagcaagcattaggatagcctgttccttttccttatttgaaggtgtttttacctttctcagcattccataaattacttcctccttcctttgttctcctctgcctttgcctcttttaaaaagttctaagttgctagccaatcaggactaatacagaatgtgaggttccattccagccaatggagactggacatagcagtagggtggacatgtcaggttataaatgaccctgtctcccttgttcagtgtactctcatggcagaacagctggcgagtgtaccctttctgcagaaagtaaaaatgcccttgctgaggaaattaaatttatgttcaagtaaatttctttatggcactgggaaacaagcatttctaacaattttggtggaaatccgtacatggatacgttctcttctgggggcggtctccagtcctttctcatgagggagcacactcctctgcctcattgcagtggcctcagggatatggaattaagatccacctggtgtgatgaataaacccagactctcagcaacgcaggaaaaaaaaaacaaaaactggctggcgatctggagtaaaggatcctcacatccacgtgaaccaggaaactctgtgcccaaatcgacgaaaaaaaaacactgggagagccggtaaagtatttccttggggtggttaaaaagaggtgagaaatccccattgggggggttaaaccttaaaaagaggtaagaaatccccattgtaggggttgaacctcaaaaagaggtgagaaatccccattgggggattgaacctcaaagaggtgagaaatccccattgtgggggttgaatctcacacaaacctccggtagtaaatatatattcaaaactcccctttcctctcttctcaggaaaagaaaaaggctaagctccactcccaccagttgctcccctaggggaaggggaaggagaggggggaaaacagcagcataggtggctggcagaggcgaagtccagcagggaggaaaaagaaaccaggaaaggaagtcagagagaaagagcaaaaacagcaagcgtgacaccagacaggcgcaccaagggttaagtccctctccccagcccagctctatgtgaaaaagagggtggggaacggcgccaggaggagagcagaggaggtgaaagggcataattattgcaacttgcagcaggcatctgccaagcctctgggccagtgatggcccggggtctggactgcagccccacaaatcccacccagcccaagaaactgagtgtaagaagaaaggaaaaaagtaaaaagggaaattgggaaaagaaaaaaaaagcagatgaaacagacggcagtgtgtgtgtgggggcgggacccatgccattgcccggccttgccggccggcaggagcaggagaacttgggagggaaaaaggaacaagggatgacggagagagagagaaaaaaagagagtgcaaatgagagagagaaatagagggaaagaataagtaagagacagaaatcaaagaaagacagagggtgaaactaggaaaagaaatagtgtaaaaggaaggcagaaagttaagacatgttgaagattgtctgtgaaagtcgtaagaaaggttataaagggaatttatgcaagaaatattgtataatttaaaagtaattaggcctcctgaatgtaaaactattaaaaaaacagtttatgtacaaagtatgtaagaaaaataaaatatacttttaataaaaggattataaggaggcataagaatatggatttttacctacattaaaaggtttaaaaatttttgttttaaaggtttaagcaagttttaacatgttaattgtaaaggaaattctgtgtgtaaacattttggctaaaggtaaagggtttatcatccagttttgctgtgaactgaacattaaaataaaaccacaatagtttattcttaaagcactaacctgctctttaacaaaaaatttaacatgttaaaaagagtctataaaaatcttaccttatagtcagacattaaaattggataatatctacaagattttattaaaattaagtttaacattaatagcacattaatataaaggtaaaatttaacttacctggtacaaaatcatacaaaaagcattgtcaaatataaaatggtgtttagctttcttaaggtccgagggcagctgggtaagtcacaagctcctcatccccaaggccacaatgtgcaggggagatgaaggccactagaaggccaagaccttaagagggggcagggctgcagcatcctgtgagtggtgctgagcaggaatggagtgggaggcatcaccatgggacctcaagccccagaatatgcagcaaaaattatatactttttatcttccactttcccttccctcagaactaaaagtcttttagcacgggtaccagccctagaatttccagtacaccagcagcagcctggaaaccacatcctcatcaaaagacagaaagaaaaaaactcgagccagcctgagaaggaccctattttatgctgttaaccactgagactgccatcctcacagctgagaaaggatggacccaccatactcaagtcaagaaaacatcttcctcgtcagaatcatgggttactgtactaggattaagccttactaagttaaagttaaagaaagcttaattttcatataccttctatattgcttcttttcctttccttattctgttactagctcctttgttattaatgtaactaagtctgagtcacctcagaccattgccttttatgcttgctctgtcataccttgtggaaatgtaaaagatcaatgacagctagccttttcacacaattatttatgcctcggccctctaattgacacagttacccctagcactcatcgttgtgatcacctgcagccaagacgctgattttctgctcctatagcctggcaaccttgtggtacatgggactacgtcctttaaactacccaggagcaaagttggacttccatgaaaaaggtttgtgcagatctaaaacctctcatctatttcactaaaaggacttccccttctaactgtcacccttaccaatgtaaccctgtcctctctatcaccacctccacctgtctttaactaactctagacctgtccttaattgcttttatggtattggaataggaattaaaagaaattaaagaatgtgtaaggagaaactcagttgtatgtaagaaaacccaattccccctgagaaagagaaagagttggagtcctttaaaaattaactgcctgtttttctgtggctagtgagccttatctctcctcctttcccagacattgtgaagaccctgtttctctagctgtgcagctgcaaggtcactagacagataaactcaagttgtaaaacatgtttttccttgaaaagtaagaaatgctgtaatgcatttctcaattaattaaataactgtctttgtttctcgcttctgtaatatgcttccccctgcacagatctccacccaccctacaaaatgcttaaaaggtaacttaactctttgttctgggctcagtcctttgggctgagtactgggccggtgcacctaaataataaatatcttcctgaaccccatttgtctctctgattccttaaaaaatcccgcaacatttctggggactcgcctgggattggagacgacagatttactgtctcctttgcctgtggggactagagcccaaggaccgggggagacccggcatccaaggtgtatcacaggggagcttcacccagacagagataggctctccccgcatcccagtggcctgcccagcagtgcaatggaaccggggatggggctgcaggaagataccagcacttcaggaaccgctgtaaggagcaagggcccaaggcatgaaagcccatcccataaggatgaaggggagcttggtcacctcccagggaccaaccagtaatccaacctagagtggctgggggcggcaggagtggcttgccaatttggatgaacctcgtgtccccactaacagtggaactgggaaaagggagaaaatgggccgatagagtggcaagtgcagcaaggtacagcttgctggcagggtggcaagagtggcttgccatcccaactgggagtgtgtgggtgcatgtgaacctacctgggacatgagagaggctcattttgtccgatgaggagtcctggggtaggagtggtctgtgtatgtgtgtgaatgtgggagcctaactaggctcacctgggacacgagagaggcttgtttcatccgatgaggagtcctggtgcaggggaggtgtgtgaaagtgtgagaaagagacggtctcgggagaggccaatgtggggagtgatgtggggaggcacagatccctcagcgtgggctgtgtgctccgaggcaagtgtgggggaaatcagacctaggacgctgcatacggctgatcgaaccagcttcacagccacagcaggctgtgacaggggaaggcacattcctggctaagcagtgtccaaaactcccgtaataggacctggtctggtggacccaagggtgaaagtgaaagggaaagtgcaccacaagggaggaaatgggagggaaagcattgaaatcaactcctttggagtgcatgatatagaattttaaaaaaagatttagaggtgattatgggatgaaactggatgctcaaaagctaaggacataactgtgaaatagattggcctgctttcaatgtggggaggccctccgaaggtataatagggaattaactggccatgtgtttaaggtggtcactggagttggaggacaaccaggatacccagaccagtttccctatatagactcttggctcaatgtggcacgaagtcacctcaagtagctacagccctgcctagagggatattgcaaggcattagtgtctcatgtggcccaaccaaaggaagcagaggaacctaaagcccctagcatctcccaggaaaaggaatccctgaagcctcagctgaaaccagttcttcaggccccacccaaggaaagggaatgtccgcccccatatgtgccagtctacccatctttgaccagaataaggcaggaggcagagtcaggagtgtccggagagttgggctcagaggaaagtgaggctcagtctccccccacagaggaccagaagcccccattataaaaaaacaaggaagatggacagggtgaggcagctgggtgcctctgctcaggccgaccacaggctttgcagatgccactttgagagaccaggacacaagtttatgatgaccaggggcagatacaaggcggccctaggctttatgtttatcagcctttctccactactgatctcttaaattggaaacaacacaccccctcctatatagaaaaacctcaggctctcattgatttggtgaattctactattatgacacataatccaacctggccggattgtcaacaacttttgctaacattatttaatacagaggagcataggagagttaatcaggcagctctcagctggttagaaggggaagccccagagaccacccctaacccacgccagttcagcaatacccaaatgaggaccctaactgggatccaaatgaggcaagggacatggaaggcctgcagcaatatagaaaggcactcctgaatgagaaaaaagcaggagtaaggaagacaatgaatataagcaaaatatcagaagtgtgccaaaagcctgacaaaagcccaagtacatttaatgaaaggctttgtgaggcctataggctgtacgtgccaattattccagaggctcctgaaaaccaaaatatgataaatatgatgtttgtcggacaagctcagggagacataagacaaaagcttcagaagctggaagactttgcagggaaaaatattagtgaactcctggaaataacaaacaaaatatacataagccaggaagaagaggcagagagaaagcaagaaagaaaaaccagaaatagaaacaaagagacagctcaatttatagctgctgcactagcagaaagtaaccctggatttgctagagggagtggccgaggcagaggccgaggaaggagacagacaagggcgggagatgaaagccagtcccagctggacaggaaccaatgtgcaaggtgcaggcaaatgggccactggaaagatgagtgccccgaaaaggaaaaggatggagatgatggtcaatgatgtaacagccaagtgtggcattcagttgctagtcgtggtgcttcaaaggcagatcctgatctgatcggtctagagcgggccgagaattttgaggactgagacagaccaggctccatctttttaggccccggggagcctatggtctctatggaaatagggggtcaattaatggatttttttggtcgatactggtactgatttctctgtggtaactcacccaattagcctccccacaaagaactgtgctactattgtaggggctactggggccaaaaaaaagagacctttttgcaaatccaggagatgtgttattgggggacaagaagtgcagcatgagtttccgtatatgtcaaattgtccagtgcccttgctggggagagacttactccagaaactgcaggcagaaattttctttacgcctaaagggaatatgacactggagtttggaaagtccaaggcaatggtatgaactccaactgtcccaagggctgaggaatggtggctgtgtgaaccgtgtgccagaaggtcaccagaaccgacctacacaatatatgggggatgcttttcaaggtaccaggtgtatgggccgaggataataccctggacttgctgcaaacagacccccagtggtagcagagcttaaccctcatgctgccccggtatgagtccgtcaatacccagtacccagggaggcaattgatggaataacaaaagcatctgaatcggctttatacacatgggattatagtaaaatgcaagtcctcatggaatactcctctgttacccatgcacaaatcaaatggggaatacaggccagtgcaggatctccgggtggtaaacaaggccactgtcgctatccatgcaacagtacccaacccatacacaatgttgggacagattcctgctgatgccacttggttcacatgtctggacttaaaggatgccttcttttgtttgaagcttgctccccaaagtcagagggggcaatcgcaatatacctggacaaggctgccgtaagggtttaagaatgctaccatttttgaggaggccttggctacagatcttgaggcttttgcgccacctagtgacaattatgtgctattacaacacattgatgatttcctatttgccgcccccacgagggaggaatgactccaaggaacagagaggcttcttcacgtgctgtgtgaagccggttataaagtgtccaaggacaaggcaaaagtctgttttcaggaggttggatatctaggattcatggtatcccaaggccagcgcaggcttaagtgcacgcaaggaggctgtatgtgcactgcccaccccagttacaaggccagggaatttctaggcgtggcaggattctgccgaatctgtattccaaacttctcccttacagcaaggcccttgtatgaggctataaaaggaaaggaaagagagcccctcctatggcaaaagaaacaggaaaaggccttcaaggatataaaggaagctctcatccaggccccggcactagggttgccaaatgtaaaaaagccctttttttgtatgtggatgaatgtcaaggaatggcagttggagtcttaactcagttcttgggctcttggcatcggccggtagcatacttatccaaaagactggacttggtggctttaggttggccccactgcctcagggcattggcagctaccgcaatccttatagaagatgccaacaagctagccctaggtcagaagttaatagttcagtgccacacgccgtagtcaccttaatggagcaaagaggatatggttggctgtccaactctagaatgctaaagtatcaagggcttctatgtgaaaatccccagataacactagagaatgtaaataccttgaacccagctaccctgctgcctgtggaggaacccgattggaaggatgctgggttgcctcactcctggcaggaccttccccactgttgcataaatatggtggacaaagtgttctcgagccaggaagacctcagagattcccccttggagagcccagatgttatatacttcactgatggtagcagtttcataacagatggggtgagatatgcaggatatgcagtagtgacccaacactcagtggttgaggctcaagccttaccttctgggacttccgctaagaaggctgaattaatagcattaaccagagcactgttattggccaaggggaagaaagtaaacatatgtactgactcaaaatatgcttttgcaaccctgcgtgcccatgggggaatacacaaagagagaggacttttgactactgaaggaaaagaaataaaaaataaagaggaaattttgcaattattggaagccgtatgggctccggagaaggtggctgtcattcattgcaaaggacaccaaatcaggaaaagctatgaggtgcagggcaacagaaaggcagaccaagaggctcggcaggcagcaatgagcaaggcttcacctgaagaaagaactctagcaatgcctctccttatagagccccctttgctggaggtacccccttactcttcgagtgaaaaagcttgttttgttctggaaacagggaaatatattaaaggtggatggtggctgttctctgatgggagactagacgtcccagagacaatagcctcaaggtttgtgaagcagatccatcaaagaacacacactggaaactagagactttgataggtcaacacttctatgtgccacggctctctgccatcacccatgctgtttgcgaataatgtctatcctgtgtctggaataagccaaaacaaggacctattcgacccccaggaattcaggaaatgggagctgtgccttgtgagaacctgcttgtagactttaccgagttgccttgagcaggaggttaccggtatatgctagtgtttctttgcaccttctcagggtgggttgaggccttccccaccaggactgaaaaggcacgagaggtgacaaaggtgctactaaaagacatcataccaaggtttggattgcctttaaccctaggatcagacaatggtcctgcatttgtggcagaagtagtactacagctgactcagcttttaaagatcaaatggaaactgcacacagcctactgaccacagagttcagggaaggcggaatggatgaaccagacactcaaacagctactaaaaatgttttgccaggaaactcacttacgatgggatcaggtcttgcccatggtcctcctccaggtcaggtgtacacttacagaacaaattgggtattcaccctatgaaatattatttggaaggccacccccaatcattaatcaaattagagggtagttaaaggagttaggagagctaacccttagaagacagatgcaggctttaggagtggcaatgcaggaggtgcaaggctgggtaagtgaaaggatacctttaagtctaacagacccagtgcatccacataaaccggggattctgtctgggttaaaatgtggaatccaggctgggcctggtggctcacacctgtaatcccagcactctgggaggccggcgggggggagatcacgagatcaggagaatgagaccatcctggctaacacggtgaaaccccgtctctactaaaaatacgaaaacaaaaaattagccaggcatggtggtgggtacctgtagtcccagctacttgggaggctgaggcaggagaatggcatgaacccgggaggcacagcttgcagtgagccgagattgcgccactgcactccagcctgggcaacagagcgagactccatctcaaaaaaaaaaaaaaaaaaggtggaatccaacaaccctggggcccttataggatgggctccatattgtgatcatgtctactcccactgctgttaaagttgcaggtgtcacaccttggattcaccatagctggctaaaaccagcggcagcagtgactccccatgacgaccagtggactagccaacaagacccagattgccccaccagaacagtcctatggcaaaacccaactaccggtaagaaggacaactgccctgctctgaccacaccggaggctggtcagtctacgcacaggtgaagcttgagaatcctgcaagctctgctctagtcacagcccggaagctgactagtctatgcacagccgaagctaaaaggaccatctccggataagcaaatgtggatacaatttataagcctagctataattctgtcaatactggttattatgttatgttattactgcaaatgctgcaaatgtctatgcccagaggaaggtttgccatgcccatgtgtagtgtaagcatgtttctattatatacactaatgttcttaccatttctgcctatactaaaaaaggagaaatctctagaaagatgcccatactgtgtacacactacctgggtaagaaacaccatagttaaaactctactgtaccatacctactatgaatgtacaggaaccaagttaggaatctgcacatacaaccagaccacctattcattctgtgacccaggaaataatcagctacatgtaggttatgaccctaaactcttaccttatgaattctggtttgaggtacatattaaatcagagggagaaaaagaaggagagcttatagctcgaaccaaagaagcccctccctcctataaaaggcgtagttccttgtactttgatgcctgccatgccgcatatgttcataatcttaaaaaaaacagaagcagcctgcaatggtttaacacaagagaggctgagcaggaacagccctaaacatctgtatggagaaccacaaatcggatgcccggaccgtaacattcagtggtctatgctaacacagctccaacacttatattcaggatggactgctctgctaagtagtatgtcagtcaaactaaattgtaagacaaggacatgcaattctttaaattttactatcttaaagccagagctacctttttggtctacagggcaggcagcactattatgagttgatagacaagaagcaggccttggagttccactactgattgtcaaaaagactagaaggactcaaatgtgtccaatcccccaattctgggtccataagtcattctataagcattttgatcagccagtgcctgagcttcccccatcacccaaaaacatatttgctcaactagctgaaaacataactggcagcttaggaatttcctcatgctatgtatgtggaggaactaatatgggtgaccagtggccatgggaggcaaaggaattaatgccacaaggtaacttcactttgcctaaccctgccagtgaaccaacagcctcagccagtgtttggttgttaaaaacctccgtaattaaaaagtactgtatcacccgatggggaaaggctttcacagaggcagcaggagaaacaacctgcctagggcaacagcattatgatgagactaaaaacaaaactctacggagaaatgcccagaatgactcctacttaccaggtccaaaccctttctcttgattctctactctaagccacacttggaatcagctagaggctccaaatgcttggaaggcatcctctggcctataatggatctgtggagcatgggtacatcagcaactgccggctaaatggacaggggcatgtgtgttaggaacaatcaagccatccttctttctaattcctctaaagcaagaggaactcttaggatatccagtttatgatgaaaataaaagaagaactagaagaagcataatcacaaaaatagacacaaatgtcaaaaagatgtggacataggagactgaaaagataatgaatggtctcctgaaagaatcattaaatattataagccagctatctgggtgcaagacggttcatggggatattgcaccccaatctatatgctcaactgcatcataaggttgtaggtagtccttgaaattataaccaatgaaacaccaagggcactaggtttattggcaatacaagcaacacaaataagaaatgctatacatcaaaatagatgagctttggattacctcttagcctcagaaggaggagtatgtagaaaatttaatttaaccaactgttgcctagaaatcgatgataatggccaagctattatggaaatcactgctagaatgggcgagttggcccatgttctagttcagacttgatccgggtggtccctggattccttgtttggaggatggttctcagcctttggaggattcaaaaccctcattggtaggttcttgcttattcttggcaactgcctcatcctcccttgccttttacccctgcttactaggagtattcagtcaactacagaggcaatagtaacccgacacactaccgcacagttgatggcattaaccaaatatcagccactgccagtagaagcagctcagctccgcgaagaggtggcaagtagtggtgctttctattaacacctttgttataaaaagcaccaaaggggggaatggaaataggaattaaaagaaattaaagaatatgtaagcagaaactcagtcgtatgtaagaaaacccaattcccctgagaaagagaaagagttggagtcctttaaaaattaactgcctgtttttctgtggctagtgagccttatctctcctcctttcccaggcattgtgaagaccctgtttccctagctgtgcagctgcaagttcactagacagataaactcaagtcataaaacatgtttttccttgaaaactaagaaatgatgtaatgcatgtctcaattaattgaataactgtctctgtttctcacttctgcaatatgcttccccctgccccacgaaatgcttaaaaagtaacttaactctttgttcagggctcagttctttggatcttaatcttactgggccggtgcacctaaataataaatatcctcctgaaccccatcagtctctctgattccttatcaatcccactacactatgagaacctacatctcaatggtcaggcattgatcagacattgtggcaatccccacatttcttgccacagggccctgtcaacacagcagccaacaaaggtttactgagtgaagtacatataggtacaaaaagacttatagaaccattattttcacaataaaacatcttacccctgttgcccactgccagagaatagccatcatctctctcctttcaaggacccttgtaaataaacacatacaaactgacagaagcaggaaatgtgaggcagcatgtttaatcatctccatctattcgaaaaccccatgagatagttatcattgttattcccattttacagatgacaaaactaacacaaacggagagtgatcaagtgagattagccagctagcaacaggaagcaaagcaaaatttcagattccagcagtttagctccaggaagagccagcctgacgaggagacatcttagttaaaatcagaaagaggctgttagatcgtcatcccttcccatctctttgaacgtgaattggtcaaatattttccagctgttttcttacccatcctctgggaacatgaggtatgatgcgtgcactcatccattaggatcagtcgttggggtgactggaacccacagtacatgtaggggcccacaaactagtttaatttcttatataaaataaggttgatgaaaagggtcattgtgcaagcaaaaatagaatgagtcactcaaacgatggaggataggttctatggttaaaacctactctctatattcaggacattaacaagtcctgaagtatctacaaaacacttcttaaaggaagaatcttagagcactcaatctgtcctggctgtgattatttgacaataaataaaatgtatttattcctaaacaagagctcagaaagatatctgtagaaaagggcaggagtagaggaaaagagggctatgcagcagcaggaaagaagggaaatcactgcaggtccacagcaccagctcagcacagaaggtaagtgcgcatttgtaatgggtctgtagccagagacatagcagaagctgcgctatccacagtcacaaccaaaggcaaaggaaggatgccctgcaattttagaaatcttggctgcagctgggaacggtggctcacgcctgtaatcccggcactttgggaggccgaggtgggtggatcacttggggccagcagttccagaccagcccagcaaacatggtgaaaccctgtctctactaaaaatacaataattacccaggtgtgctggtgcgcacctgtagttccaggtactcgggaggctgaggcactcctgagtacctgcacaatacatgcaaacacccaccccatcctactccccggcccccccgccctactccccccctccaccctacgcccccccgccctactccctcccccgccctactccccccaccccgtcctactgcccccactccaacacgtgctctcccgtgcccaaggcaaggccaagcccctgaggcatgcgcacctcagcaggcccaacccacagcaaatagtgggaagaggaaaggcaagagaggaggtctctaagtggatacactgttactgaatctaggtacccagaagatgga[132 bp omitted]tgcatgtttccacccttgcactttgatgtggattcattactaagaattaatagtggactttctcaaggagtgtgctgcatttttacatagtgcatttgcgcagcccacaagctttgcaaatccaggcccaagctcctgctcctggagacctaggaagcatggggctagtgcaaaatctcccttatcgccataaaatgggcttgcacaattcagcacagcagcttcccccaagttccacactcacgcatgcctgtctacaggacaacgcatgcaagcacgcaccccatcctactccccctcccacgccctactcccccctcccccacaccctactacaccacttacccctccccccccacaccaccaacgcgtgctctccctcatccgggcaaggccaagcccctgacgcatgcgcacctcagcaggcccaacccacagcaaatagcgggaagcagaaaagcaagagaggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacagggtcagtaccttgatgggacacatgcttttgcgaactcaggaaaccaaggttctctgggagaggcgagtagactggatgatacccctgcactaccactgctctcagagtgtagcccctcaccacctccttccaacaccctcaggaccaatgccttgatctttctcttggggtttctacttttccagatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggagacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagcgcattttccaacgcgagcagttccccagtgagttcctgcggtaagcccattgctctggttggcgcgcggtttgcagggaggcggcgtttggctttcccgcagtccctctcctaccctctcccctcctgaaccaaaacccatctggggcctggtgttgctgccgtcccctccccgcagacccctggcacctagtgggttctgtagtggggctatgcctattaggcatcatgcagaatttaaatgaaccaagttgggcaactttgggctgaggtcagttatgataaataactcctatcccaggcgaggcagaaataaagatgaggagattaaggttctgtacagcaagtgcagggtcgcattctgaccttatttaaaattctgagaagtccgtcgttcgtctgggtttcctttggtgttaatttttctaagtttcaaatagtaagttagaatgtcatttatattgattaacgattttttttgttatgggggggttatttttttattttttggagaaggagtctcgctgggacacccaggctggagtgcaatggtgcgatctcggctcactgcaacctctgcctcccaggttcaagagattatcctacctcagcgtcccaagtagctgggattacaggcgccagccaccacgcccggctaattattgaatttttagtagagacggggtttcaccatattggccaggctggtctcgaactcctgacctcaagtgatcctcctgcctcggcctcccaaagtgctggcattacaggcgtgagccaccgccctgatttttttttttttggcatctcctttatttgtggcatgagagaaatgttcctaatgtgaggctcagctgggtgttacagaacagcctactgggtgtggggagttggtagaataaaaaaattaaacacaagaatgaaacgacacccacaactccaaatgctgaacacgtgtggtttcttccatagaaggaggctggcaagaagcatgaatgtgactgaactcgcagtgcaggtcagtaaaccgaaaaagcaatcgggcaggggagccattctaaaacccgcttcagggcttggacacactttgacccagacattgccatcttggtgtttttgtggcctttttcatgtataggcaatgaggtctgaactttgggatctttgtggctggaaaatgcagtaaggaaagctcagcttgtggaaatttcccattaccagagggaacatgacaatccacggaaaaaaaaatgagtactgaactgtttcctttattccttgtgtataaaatatattatacacttgaataaattacaaatatataaatatatgtattccaaattacaaatatatataatatataacagtataaattaaatatagcataatatataagattgaattcctagcactggtatcctttaggtagcacttccatgtggaggcatcctggggttttctgacatggggattattcgaactaatgctccaaagagctccattaaactaaactatttaatatatttaaaaccaagcataaactctttggttaagaatttataaatgtttaggcattggggtaaaggaataattcccaaccagaacgtatgtttccttaagctgagactgatggcgggggatagcataaagttcaagcgcctggccctcctactattgtttttaagtatttggtgaagccttgtagagagtggcagctctaaattttaattttctggaatactttgatatggcaggctgaaaacattgctgacatagttggttttgcattatggtagagatagcgaaaaggcttgcaacctttgcaagtttatctagaaaccaaaacaaactacaagatcaatttttcataaatttccaccaacctaaggatggaagtgttaggcaagaattgtatacagtcacactcatggcttggggaagctgcccccattcaacttttgaagctaccaaatgcatcagtgaatattttcttgatcaatttctagcatttaagagattttttgtttcttccagtttgttgtactaacaggaagagatgtgttttgtggaatgtgttgatagtgggggatggctgtcaggtcaggctagactcttacctgtggtaatttgaaatacctttttatttatttgctcaggctgtgataataaatttgtaggtcagtggatccaaaggagtatttgcaaaaaaggaagaaaagaaagaaaaatcgggatgaccttaatagcttttctgcagagctcatgtgtgtgagtgcagtgagggaactatgctgcggttctgtcaatggtggcatgcagaaaagctgcctgacaaaacggggcactgagtgttggcatcctgttgccctccattttctcaggcaggcaatgccaatttgggggagatgaaatattgacgttttggtgaattgcctttcccctccctgggtttacatagcattcactcaatgcagttctgaaggcaaaaggaccactctcactcagcaaataaggaaaaaggcatgatgttctcatctattgccaaacatttcagcatgaatatctccaaaaatttttaatagatgtttcccccctctgttttgtaaagatagtaagggctggtttatgaaaccgatacggagactagggacctaatgttgtcccatagcacatttggcccacttttggcattgcttatgtttatgaacctttgaccacaggtacattggaattgtctctaaacaagcactattacggtaggcttaaaatttagactatgtattcatgagggagaaggactccaaatagtaagatgggagaaggaaatggggcatcaaacagggagaagagtccctttgtcccataaaatttgcagtttgggaacttccagaaggatcaaaatacaatggaaatgtcattaactagaagcttgggggatagtgttgtttaattgacaggttttattttttggtcttttaacaattggcaggtgtttggggagtagtgttttttgatacctcctccacattactactgaacgtgttcagagttgcctatttggacactcccgctttgggaatgctgatgagattgggatcttctgctcgagtagtgaggctagatggctgaaggcgtcccatggaactgggcaaccaagtctctgtcccatatcccaggactatagggagaacaaagtgagctgaccttgtccttagcccaggaagatttggagggagggatgagttggagcgtgcagaattagcaatgcttcctttctctcaaactctcaactgggcaaagctttttgagaatttttgtgaatttggacaacatttgtgtcctccttccacaaagcttcaagctgaagtgtgaagagtgtccagggcttcagataccctcatttcccagcaagacaatccacaaactccctgggccccctataacgagacttgccttgcaatataccatctttttaattctcaaggagtttcagaagatgaatgaccccttagaatttcttgaaggaaagaaaacttgttttaaaatacaatgtactcttaccgattttttactttacactgaagatgggcttttcaaaacgggggcctcatcttcttggtatgactttaaaaggcacccccgcctttttttccaagctcagcttcccccacgaccagggtgacagtggcctagtaagtaggagttggtgggcagctgggtagctgatggtcaagtatctgcaagcagacatgccacacatagcaataccagcagggatcgagtcccactcatcagctacacctgcacccaagagtggaaaaagtaatattacagataaaaggagagagacaaagaaataagccaagccagagcgtacgtagcacatacttggagctcactaggggaaaggtgtggtggtcacctttctaagatattttagtagtaaggaagtagcttgtcttgatacacccgaaaaggttaaggacatagagagttgcttgttgtgtttttttccatgatgaaattaaatgctcagtatactaaacctgtttcttttttcctctgattgaagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaaccgaatgtcacggactctcgtctcatgcagtaatcttgagtcaccatctgggggctgtgcatgtcacagaattttcccatgtgcccatggcaggcttacaccgacccagacattctcttccacccccacccccaacaccccatactcatctcctctctgcccccattgataccaggtacatgtgcaggatggggtggtgtgagtccctaatgagagaatagtgtgtttcaagttactgccagggtggaaaacagcaaaaccaaaatggtatcgggaaggaagccatgcccactcttaaaaattcattaagttttttcttgctatggaagacttctttaaagtaattttcttgtaaaagtgtaagtgtaaataatgccatgaaattatacacttatttaatggctaaaatggcaaatttttatatggtttaccacaacaaaagaaaagaaaaaatataccaaaaagtttttaaaaagtgatcatgaacattgtggtcatcctgtgaagtgattgcaatgcctgcagataaggagtgatggttacaacagtattttctctgaaaattatttgatggccagtttcataatgattatgttttcagcctgaaggaaaattccattttcttgggtgagcatgaactttctgtcaggctgtctgctgcttttcattccccacttctctcttcacaattgtgggtgtcaagcttcagccacgcaattgcatttggtgtgagggttttgcaaggagaaggaggtttattcatacccctgaagccacaagccttggtgggaataaggaaagtccatgaattcactatgcattaatgcatgcctcttggccaagtggattcttttttcttctccgattgagattttccttttttttttttttttttttttttgctcttgttctcattgtattgtgctttgtataattatttacagtaagtcgcgcatgtcagtgtacattccgtctggaaattgtttccatttggtacattttgtgccagtcggtctattcctgctcattattttgttttttctacattcagactgaaacatttggtagcctagagatactcagaaataggcaaagaaaggtaaaaggggaggaggggagattgaaatcatacttccattatccctccccgtggttatcagattcataaaatttttacaccatcaaaagacatttttagccatatatgtttcctttatgtagaaaatgagatctcctatactcagttggcatttgttttcatgtatctgataagtacctgttagaattataggtcaagatgttgtctagctctggtaacctagatcctgaacttcaaagcagagttcttggaccttaagaaattcaaattcgtagaattatagttaggatgtcatttactgaccttgaacaacacattgtttaggtagcatacaatgggactagttcaaggggctgggtggagaacaagttacaattttttctgatggagaacattactggagacagtaccctttaaaactttcattccctttttattagcagctaacgtcttgtatgcctttactatgtgacaagcaataaaataatgtccttggatgattttgtttgatgctcaaatgaatcctaatagtgaggttctagcatcttcattgaaagaagaggaaacttatccatggtgcaaagctaatcagaggaacaggatctgaagccaaatttgtctgcctccagagcccatgctttgtcaagtttaattcagcggtggtgcactgggatgccacagttagggcaatctggcttccaatcccagatgcaccacttcccagctgtttccccctgggcattttacttaagctctgtagtatcattattattctctataagatgataatattatatcacagaattgatgagagggataaataacatatgtaagtggccttccacaatgcccagccagagtaagcacacagaaatgttttctactattattctatattatctcctatcatcatattattataacctgttgttccacctttcctatgtggtataacagaaagagatctgattaaaaataaggtggtctgggttcttgctgcagctctacgctgtctttgttaccttgaatgagtcgcttaacctactatatctctgctgtctcatgtgttaggccattcttgttttgctataaggaaatgcctgaggctgagtaatttataaagaaaagaggtttagttggctcacagttctgcaggcttaacaggaagtgtgatgctggcatctgcttctggtgaggacctcaggaagcttacagtcatggtggaagacagactgggagcaggcatctcacatggtgagagcaggagcgagagagtgggtgtgggaggtgccacacacttttaaacaaccagatcttgtgataactcgctcactattgcaaggacagcatcaagccatgaggtttccacccccatgacccaaacacgtcccaacaggcctcacctccaacattggggaaaataaggattacatttcaacatgagatttgggcagagacaaatatcccaaccatatcatctcacctatggaatcatgacagtaatagcatgactcatgtatttggagtaggtttagtggtaaaagtttatcaggcatatttcaaaaaatcagaaaaaataggaatgaatgccttatgaaaaaaatcatttcacgcattgttttctagagtgtggggagtaccattcatgtttatatgcatgctcgaccccattttcccagatcaacaattactgtttgtcctttcttgacagagaaaaggaatcaaatgaagtgaataatatggagaggaattttttaaagtgagcagagtggatatttgtaaaggcttttccatgttttcgctatggtagtgataactgtggctgtctgtataaaaagggtgtatcatttaaacatgccctgaaatggttaatgatgaaattatgtgatgtctcgatgtgcttccaaataatcccaggttgggtgcagggatgttggagaaatcagcaaggctactgatgaaacaagactggatattaataattgttgaatgtgggtggtggctatatgagtgttcatcttatgtttgttttatatattttggacatttcctataatttttaaaaaaatagtaagggtcgaaaacctagctgctaacagggccgggaaggtaacataaatgaagaaaacaagcagagtggggactggtaaactgggaaaggctatgtctcccccaaagggaatggccactactctgcttcagcctaatttttctggtcaggactttggggtccagatctggcagattttccagtttgtaaagattggccagaaataagtgtttacatgaaaccttctgatccttagatctgagcaatcaattcaaatatgttttatttaaaattacactggtcatccgaaacagatctgcagaccagatataggatgcagcttccaatttgcaacctgtacttgagaaggtaactttaagcaaattcaaaaccgtggagcaatagaatatgattgaaagcaactctaaagccagcaatcctaggatgccatcattccaccttattttttttctcattataagtcctgttctcatgtgataaaagaaaaacttcagccaaattaaagttaaaggagtttaattgagcaatggacgatttgcaaatcgggcagcccccagaatgacagcagattcacagagactccagtgcagccatgtggtgggagagttatagacaaaaaagggaaactacatacagaaatcagaagtgagatagagaatggctggattggttacagctcgacgtttgccttatttgacattttcattttaccaataatttttaaaactctctttatttcccaaaaattacttaagacacatgaactaaaaggcattacactttttacttttctgacaaaatatgttatttaagcttttattatttttaaaccaattagtgaaagctcttttatatataaacatcaaacacataatacatataaatccatagacagaagttaaaggactcattttccaagccaggaattgaacgctgaacccaggctgccattgtgaagagaaagcatggccacatggttacaaggtcaagctcccaaggacatacaagacaagagggaaaccttatccagttttttttttgttttgttttttgttttttccagggacctgcagcaaagcttataagtgatcagtttgcttggctgtcttgaacagcgggcttacaggtgtcctaagcctgtattctatcctaaggtacccctcattaatgacagaaaatatggaaagacacacaaagcataccaaatttggtacagcttaagactagccttacaagtgctttttctgattaatttaaactttacaggagagtaacagtgatttttaccatttattcaacctgtttgcacagagagagagagagagaggccaggagtctgactggtaagaaattgttacctgtttgccagcatgccaggcttctgtgttccgttgccctaagtggccctagtgacccacctcgctgcaccatagacctggggggccaagccacaacacaaaggaaaattatctttttctgtttgggccagagtaaaatatgtgtgacgaaacatagacatcagctactctgcttagcacccaatattaaactggcaaggcttaaatttgtccttagatggctcccgtcatctttaatccaacttctgactaggaatttcaacacgtccctgggcaagatggtcaccctgagtaatagaaaagataagaaagggaaaggagagagagaaaagcattgcctgtggcagggtggggaaggtgaagagctcacagaggccagagaaggacccactcattcattgcagtgacactgaaaatgaaaagttcaggggaccacttgccagtagtgaagggatcttttccagcagttccatcagctgtcaggattccccttctggggaggaaaaagctccccatctcccacggtcctgcacatgcctaatcctgtcacccatagccgtcagcaaaaagtgtaagaccgattaatccaaagagaatagcacttaacattccatagtgccaaacccgtccttagccaaaagggattttaccaagagccctcatttttaaatgtatttcaatgtgttgttgttcatttggaacgttccactgtaagtacaagcgattctactgcctcagcctcccgagtagctgggactacaggtgcatgccaccacgcccagctaattttttgtatttttagtagagatggggtttcactgtgtttagccaggatggtctcggtctcctgaccttgtgattcacctgcctcgacctcccaaagtactgggattacaggcttgagccaccgcacctggcctcttgttctcttattttctcccgaacatacagaatcgctctctctgttctgagccaactaaagctgggggtggagtgacataggtattaacacccctgtggtcaccaccactatgactgtgctgggtcagacctgaagccagcacagcactgggtctcacccaaggcctgctgtaaccactccctggctactgtctctatgtttgcttaagaccctgggctctacaatgagcaggtggcaaagccagccaggcctgtgtccttccctccaggtcagtgagttcccccaggccccaggtgggtctagaagtatcatccaggagtcagggactagagtcaaaaaccttctaagtctacctggtgttctattgtattgcagctgagctggcactgaaaccataagacctagtccttcctgcttttccctcccctttccaaaggcaaaggagcctcactccacagccactgccacccctggccacaaggagcactgacagactaccatcaatgttccgttaaggcccaaggtctcttaagttagcttgtggtgaatgctgcctggtctgggactcatccttcagggcagtgggctcccctctggcctggggcaggtccagaaatgctgtcaagtcctggaatctggaacctcaagaacctgcttggtgctctagcccccgtggtggtgttggtacctgaagccagcaagtctcagaggctcatgatggccctcaatgtagtgcctgtgcattgctgttggttattcagggcccaagggctcttcagttagcgggtgatgaatgctggcaggatggggtcctttccttcaaggcagtgggttcccttctggcccacagtttgtctagaaatgtcatttgggaactagggctggaacaggggcctgttgactctgactggagccctatcttgctgtggctgagttggtatccaagatgcaagacaaagtcctcccaactcttccctctcctctcctcaagcagaaggaagggctctcttttagagccacaagctgtgcatcctggggttaggggaaaagtgatgccagcattcccttggctgtcctagctagtgtctcagcatgttgtgttccccgccccgccacccccaatccactgtgtctgggcctagttcatccctaggacttacctaaaagttgcagtccttatggcctaggctgcctttcaagtttacttagagactgacagcactttggcccttcatggtgaggtttgcaggtactcaagttcagactgctgggatcagtgattcccctctggctagggctggtttaaatgctccctctgtgagtgggcatcaactgagtttgatctggttttcctttctgctgtaacaggacattgctgagtgcaatgcttcacaattgaattgtgaagcaaaagaactgtgttctctcttccccagtgcccagaaacactctccacaccatgccatggctgccagggtggggaaggggtagcattggtgattcaggattgttttctatatctcttcagtgcctctttcagtgatacgaaattaaaaccaggtactgtaagtgctcacctgatttttggtttttaagaaggtgtttttttctgtgtaggtagttgttaacttggtgtccttgcacagagtggcaggaggacgatcagcggagctttctattctgccatcttcgtctgcctcctttcctagcctcatttccccctgcttcctcctctgccccctgggtcctgagcacatgggtcttgagaacacaccaagctccttcccaccttggggcctttgcactggctgttctctctgcctggaatgctcttcctacaggtttttgcatggctgcctcctttactgcattcatgattctgctcaaatgccctctctaagcacctgagctaaaatccctaaccccgcagtctctctacttttttgtttggttattggctctcttgtttaatctctgtcttcctaccagagggcaggattcagaatttaaacagtgccctagcacataatgagagctcagttatcttctgttaaagataaaaatgaagccacactttaggtgtacccgaaggccaaccactcataaccaggtaaccaaaatttaattcttcccaatttccccaaaacactgtctctaatcataaatatcaaacataacctttacatctttgtcagcgtgattcagtgaaattaaaccaatcagctataggcaaatcagtttaaacagctctgtttaccttaaaaagaatgataacgtaaaacagccaaccacaaaaaaaaatcaaaatattctcctttatgctttataaagtgtgctatgactgccataaggtgagctttctaccactttgtttgaagtctcctgggtcatgagctgtactttctcttactgtataacaataaactttaaaatgtttcctaacttgatctgattctcattttgacacttccaataatcttgagaaatgctcctgagcactttgggtctggtattcttagagagggcaaacattctcatttttcaaaggggaagttgaggcccagagagagacagtgactgcctgaagtcataaagttccagcactctctttccttactcccttgttctcctggtcttggggacatcagacatctttaaacatttggtctcaccatagaaactttgagatccagtgcattagggttccctagagggacagaacaaataggatatagatatagatatatagatatatatgtaggagatatagatatatatatgcatatgtaggatatatatatgtatatgtaggatatatatatgtatatatatacagaacttatatatatatatacagaatatatatatatatacagaactaataggatatatatatatcctccatatatatatatcctccatatatcctccatatatatatatcctccatatatatatatcctccatatatatatatcctccatatatatatatcctccatatatatatcctccatatatatatatatcctccatatatatatatatatatcctccatatatatatatatatatcctccatgtatatatatatggagttaattaagcattaacttacatgatcacgaggtcctacagtaggctgtctgcaagcttgaggagcaaagagatccggtctgagtctcaaaactgaagaacttgggagtccgatgttcaagggcaggaagtgtccagcatgggagaaagaggtaggctgggaggctaggccagtctctccttttcacatttttctgcctgcttcatattcactggcagctgattagattgtgcccaccagattaagggtggatttgccctgtgcagcccactgactcaaatgttaatctcttttggcaacaccctcagagaacacctaggatcaatattttgtatccttctatctaatcaagttgacactcagtattaactgtcatacccagagtggctgttacttcccaaaaatattcagtctgtaattgataaagtggggtttttatcctggtatgtcagacttgtggctgagactttctgacacttgtgaggctggaagggaaagaggcagtggataaagtgggccttggcttgttctcataggttgcaattaacatctgaagcacttgctttcaacctgaagaacttcattatttcttgtgaggtggatctactaacaacaaatcctcccatttttatttaactgggaatgtctttgccttcatttctgaaaggtagctttgctggatgtaggattcttggttgatagttttttctttaagcattttgagtatttaatcttactgcctcctggccttcattgtttctgctgagaagtcaactaccaatcttactggggtaagtgatgagacatttttctcttgccactttcaagattttctccttgatcttagccggttttactatgatgtaatctgtttgtggattctttacatatatccttcttagaattcactgagcttcctgagtgtgtaggttattgtttttaaaataaatttgggaaattttctgccattatttctttgactattttttctgctcctctctatctcttcctttcatctcctctctatctcttcctttcttctagtagatcccacttaggtttgtgtggctgatggtgtcctacatttgtctgaagctctatttatttttcttcactctttcttctctctagtcttcatcttgcataatcactatcaatcctgtttcaaatctgctaattctttcttctgccagtttaaatgtgctattgaacctgctagtgattttttcatgtcagttattgtacttttcagattcagaatttccatttggttcttttaaaataatttctatctctttaatgatattttctactggatgcaacattgttatcatacctttattttctgaatcatgctttcttttagttcagtaaacatattattttttttctctgtagagatggaggtcttgctatgctgaccaggctggtctcaaactcctggcctcaggcaatcctcccgcttcagctttccaaagtgctgggattacaggtatgagccaccacacctggcctgcaaacatatttataatgggtattttgaagtctttctctgttaaatccatcatgtggttgctctcacaggcagttggtgttgtctgctttttttctgctgtatggggcatactttcctgtttctttgcaggtctgtatttgtctgttctcacattgttataaggaaatagccgagagtgggtaatttataaaggaaagaggtttaattgactcacagttcagcatggctggggaggcctcaggaaacatacaatcatggcagaaggtgaaggggaagcaaggcaccttcttcacaaggcagcaggaaggagaagtgcaagcaggagaaatgctagacgcttataaaaccatcagatcatgtgggactcactcactatcacgaggacagcatgggggaaaccgcccccatgatccaattacctccacctggtcccatccttgacacatggggattatggggattaaggggattacaattcaagatgagattttgggtggagacatagacaaaccatatcacatgcctcataaactttttgctggaaattgaaatcatttctgagacatggtcccactctgtcacccaggctggagtgcagtggtgcaatcatggctcactgcagcctcgacctcctaggttcaagtgatccttccacctcatcctcctgagtagctgggactatcagcgtgcaccattccacctggctaattttttttattacttttgtagagatggggggtctctctgtattgcccaggctgttcttgatctcctgggctcaagtgattcttccaccttggcctctcaaagtgctgggattacaggtgtgaagcattatgcttggccacaaaatttttgataatatgttgtagcaactgcccccaaccctggcctctgggacttgttatttgctggtatattttttttagtgattggctggattattttaatgaagcttattccttctcctcatagtcttaagcctctgatgttgctcttcaggaagacatgactttgggtgtgtacaccgtcactctaggatggcagtggtgttagtagggctctctatctttcccttaccatgcccaactattaaactccactaattgcctgctgatcattctattgttttcagcaatgctctaggacataaattgttctacaaactaattcaattaaattgtggtttatttgaaggaatagtttttgaggtccacgtctgatatttgttctgataccaggagtgctcttaccagccatcttatttcctggttttctcctgaaaactatccagcttacaggccatgctttatcttcattagatccacaaatctcaactgccttgtatgacaacgtccactgttcttgagagcactcttagctttgaactttacactctgttgcaaatgaagtcaatccctttgggaagagattaggagctacctgttttgtagcctgttcctcctccaaggcaaaatctttgagcaagagctctagagacaaggtggggacggtggcaagcttctgcctgaatggcaacccctttctatgggctgaggccttggcagagtggggtgcagcagcctaaggtgctctcggcttgcctcttcagcatgtaaccaccacctcatgagcgaggcaaggaaaacttgagccgcggtttcctcagtgtgttgcatctaaggtagagcctccattaaataactgggggacagagtcggcagattaaatgagccaccatcactcagctgtactcacctgatacttagcctcagaaacaagtagctggtgtcagtatgaatgatgctgaagtgctgctcctcttgggaagaaagtcctctggctgggagccagaggggagagggagccctatgctcttgtctgcagcagtctgaagtagaatctctgccttactgatctgggaggggaaaaggaagaagctgtagtgattcaaataccacagacttgcttttcttattgaatttttgtaggttctcttagaaagacgtttcttcatttgctgttttcccttaggaccatttccaggggctttaagttgttgttttaaaaataatatttaccactttcacttgggagtgcatcagcagagttcctcaagctgtcatgctggaagttgaactccgtgtttggtacttttttcatttgcacagtgatcttgttttttctatgcctagacaaggttatgaagtggtattttttttctcacttcgtcaagatcacagagtgattttgtctggcagtagtgctctgtgagactgtttatgttcaacaggaaaacatcaagacctagttgtgcgtaccaggccagtgctggctgtcagggactgcgatatggtttggatttgtgtccctacccaaatctgatgtcgaattggaggaggggcctgatgggaggtgattatatcatgggggaggatttccccattgctgttctcatgacagtgagtgagttctcataatatctgatggcttaaaagtgtgtggcactttcccccttaattttttgctctcctgtcaccatgaaaagatatgccttgcttccccttcaccttttgccatgattgtaagtttcctgaagcctcccagtcatgcttcccgttaagcctgtggaactgtgagtgaattaaacctttttttctttataaattacccagtctcaggtagttctttatagtatgagaacggactagtacagactgcttatcaccttctcacagtgtagaacaatcacttcgtaattattctgtctaaggggcaaggaagcttgggcatttatccaccaactcccaataatcattggttgagggctgctcctgggggcatttattccccagccttccctgttcaggcagaggggcttcagaccccagaggaagcatcaagctgttgcaaattgggccaagtacatatggctgagatctagtaggacacagacaacatctgctatagatgacctgccaaagatcctgaaagggccaggatttgagctcagtgttatctgatgaccatgtcttagccaccacttgatttcgtgaatggagaggtttgaaaagaacagcagaactttgctagaggggttgtcaagattacttgcctgaacagtttctcatgtatatattacacagactgttggagatacctgctctgttcccagctcctggctagacgatggggtcacaaagatgacccaggcatgttttctgctcttatggtacaatctgtctgttgagggtgggatatctgaagggacaagcccacacttcgtccccagtcccacctgtgttggctagggagtccttcctggaggatgtgttgcgtaaacaatggagagaatttagggaacatcgagcctactcttttcactttacagatgaaggaacacaggcccacagcaagggagtggtctgcaaaagagaacatatagactgcaccctggagaaggccagcttctaagtggccatgcccttccttagctccccagtcacccagatacaggaagtgctcactatatcagattcagctcctcagcacttaccaagtccatcctgcccagaatgctttccttcaaaggcctgcaggctcaaggctctgtcttaagcctgagcctttttacctctaaagaaagtaatcaacctcctccaaaggcattcagtgtcctggtatgggagaatatgtgtgtataccagggtctgggaattttgagaaaccatcttaaggtttggtgagttgctttttctccttatgtgaatttatacagtcctctatggagttctggagggaaaatgaaccaaacaaaatattttttttgagacagggtctcactctatctcttaggctggggtgcagtggcacaatcttggctcactgtagccttgacctcacaggctcaggtgatccttccacctcagcctcctgagtagctcggactacaggcatgcagcaccacactcacctagtttctgtattctttgtagagataggattttgccatgttgcccaggttgatctcaaactcctgggctcaagtgatcctcttgcctctgcctcccaaagtgctgggattacaggtgtgtgctactgcacccagccgaagattttttttaaagtgaaaacaaagtatgtttttatctatttccaaactatagcatgaatttccccaagaaacttttagcagatgctctcctcccttttgcaaatatactaaaactattttatgaaaacagtattgggaatatggacccaaaacacggttatcctgatgtagagatttggccaatggtacatttgaattccactaaaatgaactctgttatactgacctgcttttgactatatcctttatacagcactgtagagggctttctgcaggcccagagcaatggagtggcctacgtaagagaacacacatagctcagcttagaagaggccagccgctgaatggccatgccctcccctgggccagagatcattcaattaagagaaacacacaccagcccaagttcagctcttcagcacctaccacattatctagcccagaactatttcacttaaagggttgaagattcaagtcccttccccaatcatggcactgggccattttacctctaggaatagtaaacaacctcccctaaaggcattcagtatcttggtgtccattcttacaggcccttgagggagtgatacaacttgtaccctcctcacaactctcatttctcccaatcttcttgcaaatctgtgcctgaagctggaagcacaacacatgaacaataactagcttggtgcttggtgttgaattaacttttttaagaaagcaggctaacaggttggaaattgttctgtcaatattttagaatctagtaatacaaaagaccccttctaaaagcacattctgttgtgttacacaagcaaggggacaaaggtgatttcagaggtagcattcaggtgtgagcatcataattgatacatttggacccctctaaagcacaggccacagacaaaactagggcctctatgagaactgcagagttggattatgattttttatttcaagccgaagaatcttggtttaggcaaaataatggagggaaggcagagaacaaggaagagtctctgtccattccctttgaacgagagaaacaaaaaaattaaacaaaggatgttttaaaatcaaaaggtgaaagagtctgtggagacataggaggaaagaaatccatggcaatggctgagcctggagctgttgttgaggtgtggggagcttgacgataaacagcggctagcagctaggtactgcctctggaagatagccagtggggcacaaggaggtagctctggccagctgggctttaccataaaaaaaaaaaggaaaaatagaactctggtccctatataaatcagtccctaacatctccttccacagccctcatcacgaggccaagcagtaagaccaatttctctttacctctgatccctatcctccctttaactcatctggtcacattaaggggtttcagtgggattgaaattatttataaggaagaaaggaaagtaaagactgagtggaggtttcacaatctgattttccctggcccaggtccccaaccccagcacctcaaggagcacaaaatatgattctattcattttaagcacaaagaatttccaaggatttctcagaaattccacaggcctacccgccacatcaaaaaggtcaactccaaaagtgagtccgacagaaatattgtaagatgctaaatcgtctcttctatttatttaacatacagacttagatttaggagcctcttcttggctcaacccgttaggtgaacacattctatagtatcaaaattttgcataactctccactaagtaaatgtttagtccattcattctgaactggaaggaaggagactagctgccagctgtgatcctagtcaacatgcaggatgtgatgaaatgaggaagtcttcttcatggtcatcgagttactgtccaagagtagcaaccacagccaacgacagagatcaaatttcattcatctcactctgctccttctcaccattctttcccctatgaaccataggaaagactcaatccataggcaaaataaaaatgatactctgaataactcttttaacaccctcctgatatttaggcaccatgcccaaactgtcttgttccctctcacaattggtagcattctaatattgtacatcaatatctcagttaaatagaataacactaggagggaacttgaattaatcatgattgcatacttattgcaggaaaagataaataaccaagaaagccacttttcctctgctgaatctttttctttgcttagctgttttttccatatgtgttgctttatataactatttagagaaagtctcagggatcagcacacattcaatctaatagcctaagtgtttttcagctaacgccatggcaataaagtttgctctttggagtgatggctcttagacactgtattagtctgttctcacactgctatgaagaaatgcccaagcccgggtaatttataaaggaaggaggtttaattgactcactgttctgcatggctggggaggcctcaggaaacttacaatcgtggcagaaggcaaaggagaagcaggcactttcttcacagggcagcaagatggaggaagtgcaagcaggggaaatgccagatgtttataaaaccatcagatcttgcgagactcattcacaatcatgaggacggaatgggggaaaccacccccgtgatccagttacctccacctggtcctgcccttgacacattgggattatggggattacaattcaagataagattttggatggggacacagccaaaccatattagacactacaaactcacagtgaatctctggaatataccatgctcatttctgactatctttgcttgtgctgttcctatactcctttcctcatctagccaaatcattcatgtctgttttcctctcacattttctgcctcctttcacccatcttcttctttttccttctgtttctcaacctcacctgcccaattgtctccccttccagaccccctgtagacctgaagtctcaatcgctaattaagaggcaacagtcatgacttatggcctctcactgaaacataactgttttgtgggtgtaattcttatgttccctacctgcatggtaagcacttgcattttcagactgggtctcctactcttcttgtttccttcacggaagctagcagtggtgctttatgtgtaatttttaaaagggcaatgattatcgtaacagctaaaatttttggaaggcttaatgtgtgacaagtactgtgtgtgaattaagcttattgctatttcacaaatgaagaaataaagacagagagagattaaataatctgtccaaatcacagctgacaagtggctataatggaattcattgaccaaacatcccattctgttcagtagactcaaatgtgaggggaaaatagacatacataatctcacattttttttcaacagaaaataaggaaataagctgtgcacagtggctcatgcctgtaatcccagcactttgggaggctgaggtggggggattgcttgaggccaagagtttgagaccagcctgggcaacatagtgagaccccatctctaggaaaaaaatagctgggtgtggtggcatgcacctgtatgtagtcccagctctttgggaggctgagataggaggattgcttgagcccaggagttcaaagctgcagtgagctatgatcagaccgctgcactccagcctgggtaacagagcaggaccccatctctaaattagttaattaaaataaaaagaaaatgaggaaataaacaatgacatgggattcttgttcaatctcatttctttaaaacagtccattaaccagactaaatctaacccttgggtattatgctgaattaaggattcattttaatatataagtacacaatatttctggatacaaattaaacagaatagactgctgggtatgtactagatatttttctttcattcttctatttgctcattagattcccttttctgtgctgccatttttttctttataatcattaacccatccatttattgtctgttaggaagtaaggcaacatatatgcaatgaatataataagaaaggaaaactgaaaaaatgttgttttagaaaataacgttaatagtgtcacttgaacccagaagttcgaggctgtaataagctatgatcgcgctcctgcactccagcatgggcaacagagtgagatcctctctcttaaaaaaaaaaaaaaagttaactgtggattaagacatctttttcaaaagataaagccattttcctttgcccgggtgaatgctaagcagtttgtgaactcacagtatcactgggatttggaagtctcacgtgttaaaaagtaagacatgatcaaagcttgaatacagccataggtctgcttgtttgaatcccatcattccaagatatacatattttgtttagtgtttcagtatattgatatggtttatgtaacagtatatatacaactactttgtggagtatttcctgcaatttcatgtactcgcattcagaagcaatcagaagccattcttcttttttcaaaacaaggaaaacaatatttcttccatcattctacatatatatttggcacctgttaatgtcatatatgccaacagctacttcagacatctctttttgattgactagtatttcatttttcagtcgtcagtcttaaagattaatgttttgtctttctaataaatatgtagttaagtgaattccatacttatttttagatcgaccgtgtgttttcttgcttatctttctgtgttaattgaaattctgttaaacctagaaaattacttggagtatgtgttcagatgacgtggggcaggcaagcccccagactggggcttagcctgggagagttcttggctttgcccaggaaagaattcaagggtgacttggtggtattaaacagcaatcttttacttaactggagctgttccttgtgaagcagggctaactcattgacatagtgcccagagccacatttgtgggctgttggcaattgtatttatatccacttatggtcccctacccaccttaaatttggagagcctcatgtaaaatcagaaacaagcaggggactagattcccttattgtcctctttatgcccatattgtttcataattataaaatgttagacaggaacatagggtccttggatggaaggataccacataaatatattcagatagatgaaaggcagaactctttgttacttacagctccaaatgagagaaggctgccaggtagagccacacctgaagttgtaacgcaggatagagctatacctgtaggaggcagtccaggtatggcaagggaggtttcatgggctccctgtggatttgttaatttgaaacttaggcaaaagggctgtccctagttgtctggtacctatccctgtggtgattagggcaggtacatagttgccaggaatgtgagagccccataagggaaatggttgagatgtggatttaatcagctgctcaagaagaggaactgactagcctctagccagggcctcaaaattgggtcaagatggcactgaagaaaacaaaacccacaactggtggagccaagatggccgaataggaacagctccagtctacagctcccagcgtgagcgacgcagaagatgggtgatttctgcattcccaactgaggtactggtttcatctcactggagagtgtcagacagtgggtacaggacagtgggtgcagcgcaccgagtatgagccaaagcagggtgaggcatcgtcgcctcacccgggaagcgcaaggggtcggggaattccctttcctagtcaaagaaaggggtgacagatggcacctggaaaatcaggtcactcccaccctaatactgcgcttttccaatggtcttagcaaacagcacaccaggagattatgtcccacgcctgactcggagggtcctacgcccacggagcctcgctcattgctagcacagcagtctgagatcaaactgcaaggcggcagcgaggctgggggaggggcgcctgccattgctgaggctcgagtaggtaaacaaagcggccaggaagctcgaactgggtggatcccaccgcagctcaaggaggcccacctgcctctgtagactccacctctgggggcagggcatagccaaacagaaggcagcagaaacctctgcagacttaaatgtcgctgtctgacagctttgaagagagtagtggttctcccagcatgcagcttgagatcggagaacggacagactgcctcctcaagtgggtccctgacctccgagtagcctaactgggaggcaccccccagtaggggcagactgacacctcacacggccgggtactcctctgagatgaaacttccagaggaattatcaggcagcaacattttctgttcaccaatatccgctgttctggagcctctgctgctgatacccaggcaaacagggtctggagtggacatccagcaaactccaaaagacctgcagctgagggtcctgactgttagaaggaaaaccaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctccaaaggaacgcagctcctcaccagcaatggaacaaagctggatggagaatgactttgatgacttgagagaagaaggcttcagacaatcaaactactctgagctaaaggaggaagttcgaacccatggcaaagaagttaaaaaccttgaaaaaaaattagacgaatggctaactagaataaccaatgcagagaagtccttaaaggacctgatggagctgaaaaccacagcccgagaactacatgatgaatgcacaagcctcagtagctgattccatcaactggaagaaagggtatcagtgacggaagatcaaatgaatgaaatgaagcgagaagagaagtttagagaaaaaagaataaaaagaaatgaacaaagcctccaagaaatatgggactatgtgaaaagaccaaatctacacctgattggtgtacctgaaagtgacagggagaatggaaccaagttggaaaacactctgcaggatattatccaagagaacttccccaatctagtaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataggtgaaggagaaataaaatcctttacagacaagcaaaatgctgagagattttgtcaccaccaggcctgccctaaaagagctcctgaaggaagcactaaacatggaaaggaaaaaccagtaccagccactgcaaaaacatgccaaattgtaaagaccatcgaggctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagcacacccatcagtgtgctgtattcaggaaacccatctcacgtgcagagacacacataggctcaaaataaagggatggaggaagatctaccaagcaaatggaaaacaaaaaaaggcaggggttgcaaccctattctctgataaaacagactttaaaccaacaaagatcaaaagagacaaagaaggccattacataatggtaaagggatcaattcaacaagagagctaactatcctaaatatatatgcacccaatacgggagcacccagattcataaagcaagtccttagagaccgacaaagagacttagactccaagactttaacaccccactgtcaacattagacagatcaacgagacagaaagttaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagcactcctcagcaaatgtaaaagaacagaaattataacaaactgtctctcagaccacagcgcaatcaaactagaactcaggattaagaaactcactcgaaaccactcaactacatggaaactgaacaacctgcttctgaatgactactgggtacataatgaaatgaaggcagaaataaagatgttctttgaaaccaacgagaacaaagacaaaacataccagaatctctgggacacattcaaaacagtgtgtagagggaaatttatagcactaaatgcccacaagagaaagcaggaaagatctaaaattgacaccctaacatcacaattaaaaggacttgagaagcaagagcaaacacattcaaaagctagcagaaggcaagaaataactaagatcagagcagaactgaaggaaatagagacacaaaaaacccttcaaaaaatcaacgaatccaggagctggttttttgaaaagatcaacaaaattgatagaccgctagcaagactaataaagaataaaagagaggagaatcaaatagacgcaataaaaaatgataaaggggatatcaccactgatcccacagaaatacaaactgccatcagcgaatactataaacacctctacgcaaataaactggaaaatctagaagaaatggataaattcctcgacacctacaccctcccaagactaaaccaggaagaagttgaatctctgaatagaccaataacaggctctgaaattgaggcaataattaatagcttaccaaccaaaaaaagtccaggaccagatggattcatggccgaattctaccagagggacaaggaggagctggtaccattccttctgaaactgttccaatcaatagaaaaagagggaatcctccctaactcattttatgaggccagcatcatgctgataccaaagcctggcagagacacaacaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgcaaggctggttcaacttacgcaaatcactaaacgtaatccagcatataaacagaaccaatgacaaaaaccacatgattatctcaatagatgcagaaaaggcctttgacaaaattcaacagcccttcatgctaaaaactctcaataaattaggtattgatgggatgtatctcaaaataataagagctatctatgacagacccacagccaatatcatactgaatgggcaaaaactggaagcattccctttgaaaactggcacaagacagggatgccctctctcaccactcctattcaatatagtgttggaagttctggccagggcaatcaggcaggagaaggaaataaagggtattcaattaggaaaagaggaagtcaaattgtccctgtttgcagatgacatgactgtatatttagaaaacgccatcgtctcagccccaaatctccttaagctgataggcaacttcagcaaagtctcaggatacaaaatcaatgtgcaaaaatcacaagcattcttatacactaataacagacaaacagagagccaaatcatgagtgaactcccattcagaattgcttcaaagagaataaaatacctaggaatccaacttacaagggatgtgaaggacctcttcaagcagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctactaatgactttcttcacagaattggaaaaaactactttaaagttcatatggaaccaaaaaagagcttgcattgccaagtcaatcctaagccaaaagaacaaagctggaggcatcatgctacctgacttcaaactatactacaaggctacagtaatcaaaacagcatggtactggtaccaaaacagagatatagaccaatggaacagaacagagtcctcagaaataatgccgcttatctacaactatctgatctttgacaaacctgacaaaaacaagaaatggggaaaggattccctatttaataaatggtgctgggaaaactggcttgccatatgtagaaagctgaaactggatcccttccttacgccttatataaaaattaattcaagatggattaaagacttaaatgttagacctaaaaccataaaaaccctagaagaaaaccaggcaataccattcaggacataggcatggtcaaggacttcatgtctaaaacaccaaaagcaatggcaacgaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaacccatcaaaaagtgggcaaaggatatgaacagacacttcttgaaagaagacatttatgcagccaaaagacacatgaaaaaatgctcatcatccctggccatcagagaaatgcaaatgaaaaccacaacgagataccatctcacaccagttagaatggcgatcattaaaaagtcaggaaacaacaggtgctggagaggatgtggagaaataggaacagttttacactgttggtgagactgtaaactagttcaaccagtgtggaagacagtgtggcgattcctcagggatctagaactagaaataccatttgacccagccatcccattactgggtgtatacacaaaggattgtaagtcatgctgctataaagatacatgcacacgtatgtttattgtggcactattcacaatagcaaagacttggaaccaacccaaatgtccaacaatgatagactggattaagaaaacgtggcacatatacaccatggaatactatgcagccataaaaaatgatgagttcacgtcctttgtagggacatggataaagctggaaaccatcattctcagcaaactatcacaaggccaaaaaccaaacaccgcatattctcactcataggtgggaattgaacaatgagaacacatggacacaggaaggggaacatcacacaccggggcctgttgtggggtggggggaggggggagggatagcattaggagatataccgaatattaaatgacgagttaatgggtgcagcacaccaacatggcacatgtatacatatgtaacaaacctgcatgttgtgcacatgtaccctagaacttaaagtacaataaaaaaaaaaaaagaaaaaagcccccacaattgtattacacacacacacacctcttcacattggtgggaggtcccctaggactggggcagggctttgtcagcatacgtgaaatagcttccatgattccctttgctttgggtggttgcactgtggtggcagcagtctgggagccaagacaacagagatgtttccactctcagagagagccccgttctctcaggaaggcaaagtttccagtgtcccactcagtggccatgagggtaggtctggagcatggggttgggatgggggtggggggacactcatacgcttgtccttagttcattgactggaatggtcttgggcgtcagctggatggcttcagctaagttcctgttgctgtagctgtgggttggggatgggagagagggtcatctactgggggaaaacagtctcctgaaactgcccattccagactggggaaagaccgaccgatgggagaggatatgtctgaaggcacagaacattatagaactggctctccatagcccttatgccatgcccattcactcagagtaaattgtagtaaactctgcaaaaacaacaaagtgttttgtaaatcagttaatttcttaagcttgcatgaactagtcattggcaacttgattgctccaagaatggctcacttgttcacttggtcattctgtgacttggattttggcaaaatggctcttgatgaattaaccaggagtcaaaatcatgaccgccaacaccaagcaattaaggtgaagtctttgttcatgggaagaccctctttagaactttctccatggagccctgtgttccaacgggagaaggaaaatactaggattttatccttacatatctgtggggacaaatcattcttgatcctcccaatgaccttttctagctctttttttatctgtaccttcctaatgagatgctaggtaggcagaatgggcagaaagagctgggagcatggtcaagtgtggggtcttggtgatgaatggggagaaccactgtaggtacttttttttgtagacagtccccattcctaacaaactctgatacatgaatgatcagatccttgtttggagtaccagcagcagtagctgaagaagcctcagaagtctttaagcagctcttacccagggttcccagaaagaatgcttatgaatgctgttatagcaacaatttcaaccaatgggaagtaaagcccaaatatttctgcccgtttcagttcggtcaaggaggaggaaatgggagagagtgagggaaggaggaacatcaaatttatctgacctcaataacaggaccagtctgtagtatccatactcagctccttcccagcaagagatgaactcatagggctgtgcaaggaggaagagtgacaataagccttacagctggtatgtattcggaggttcttatgtgccagttactgtgtaaatactcggtatatgttgtcatttactcctcacaacagatattagtgttttcatcttaaatttcaggaaacagacacaatgctcattttcccaaggctcaaactcagaggtgtctgtgttttacttggctattcctaaattctgagatcagggcctcccttgtgggcctaaaggttactcttgtcttttatgaaagagagagacagtatattatagtatgctaactataatggttatcagcagaggcagaagcaatttacatattgtttctttttcttcaatttccttgcctataaaatggggataacaagcttactgaacaggatttttatgaggattgaatcagatatttcattgaaagactgagagcagaacctgccacattgtaatctttctttacaaggtttagatattatttctgttattaaatattttgagagaggattgtaaccacctgatgggttcttcctgcctgctgcacaaatgaagaccatggcatggtagtaaataaaagaatttaattgatgcaaggctggccacgccacatgggagatagaattgttactcaaatcaatcttcttgagcatttaggggtagggttttccaaagatagttttagggagggagttagggtggctaagcaatgggtgcttgctgctgattggttgggggtgcaatcataagggtgcaggaatggtccttctgcccactgaatatcttctgggtggggccacaggagtggctggcaggtccaggtgaagccattggtgtcagacagacaaacaaatctgaaaagatatctcaaaaggccagtcttaggttctacaatagtaatgttatctggaggagtaattggggaagtagcatatcttgtgacctccagaacaatagctggcaatcgtttatgtctacaccttagcagaatttaggctcctctatccccctagcctggtggtctctcattagctttacaaaggcagttgaattttgggaaagggctattatcatttaaagtataaactaaatgtctctccaagttagcttggcctaacccaggaataattaggggcagcttgaaggccaaaggcaagatgggactttggcatgatcagatctctttcactgctataattttctcagtgttgtaatttttgcaaaagccgtttcagcctcactctgtcacccaggctggagtgcagtggtgcaatcacagctcactgcagcctcaacctcccaggctcaagtactcctcctgccttagcctcccaagtagctgggaccacaggcacacaccaccacacccagctaacttttttattatgtgtggagactagttctt[132 bp omitted]tgttgttttaaatgtccttaattagtgaaataaaaagataataacctatgtcaggacccaattttattaactttattagtccctgacatctccaagtatcagaacccctgcctttaaccactatgctttgtatgtggagtagtttcccaccttaagacaattggtcttaattgcaatacagaaagggaagtgcttcgttaaatgtcctctgtatccaggaagaaatactaagcttgctgcctggaaaacactacacaaatctaggacccatatgtaaacatcatgctgctgagatggcatggaggggtcagggcactggggtgggaggaggaagtgtaactgcccaaggggtttaccttgcccactgcctaggcagagccgatttatgaagacaggggaattgcaatagagaaagagtaattcatgcagaaccggctgtgtgggagactggagttttattatgacttaaatcagtcttctcgagcattcagggagcagagtttttaaggataacttggtgggtggggggaagccagtgagccaggagtgctgattggccggagatgaaatcatagcgagtcgaagctgtcttcttgtgctgagtcagttcctgggtggcggccacaagatcagatgagccagtttatccatttgggtggtgccagctgatccatcaagtgcagggtttacaaaatatctcaaccactgatcttaggagcagtttaggaagggttagaatcttgtagcctccagctgcatgactcctaaactataatttctaatcttgtggccaatgttggtcctacaaaggcaatctagttcccaggcaagaaggaagtctgctttgggaaaggctattaccatctttgttcaaactataaactaagtttttctccaaggttagttgggcctacgcccaggaatgaacaaggacagcttggaggttagaagcaaaatggagttggttaagttaaatctctttcactgtcttagtcataattttgcaaaggcggtttcagaagtatgggagtcagtgtggctaaataggaggaacagagactctcaatgcagacagagggtttcaagtcacagatctgccacttactggatttgtgactttaggcaggttgttttagctttctgagcctcatctgtacaatggaattttcacagtaattagttcatagggctgaaaagaagatgaaatgaagagattcaagtagaacactcagaacaaggcctgccatgctgtaggtgtttaataaacattatcttccacagtgatgatgattaagggactaaatttcatgcacgtccatgtgaagagaccaccaaacaggctttgtgtgagcaacggggctgtttattttacctgggtgcaggcgggctgagtccaaaaagagagtcagtgaagggagataggggtgggtggggctgttttataggatttgggtaggtagtgaaaaattacaatcaaagtgggtttttctcttatgggcaggggcaggggccacaaggtgctcagtgggggaggtttggagccaggtgaaggaatttcacaaggttaattgctcagttaaggtggggcaggaacaaatcacaatggtggaatgtcatcagttaaggcaggaaccggccattttcacttcttttgtgattcttcacttgcttcaggccatctggatgtatacgtgcaggtcacaggggttacgatggcttagcttgggctcagaggcctgatactaaccataacagatagaatttaaaaagcagaggaaccaaaaacagcccaccactctcctgagctgggagaatttgcccagaattccagggataggtgtgtcctaagcttccgctaggtagggtcaatgcccagcagccaagccagaaggaagatttgggcagacactgtcattggtgaacacgtaagctccagagctagaatactactgatgatggtgactggctttggttcttccgtctggtctgacacccagaaagccgatcagactcaccgctatgaaccttctagtgccacagcaggccagaaaccacagccctgcctccccttctcctgagttcccggtgtgggtgtggtaggggcacgggtggattcagtatttctgtaatggaaactagaaacacgtagccccacagtagctgcattccaaaggggcagagatctgacttcctttgtttcatgcttttagagacaatgacagcaagacctctcacaggaagtgctaggaccactggagagagtgaattcaactcttggccaaaaacctatgggtgatctttcaggcctcgccataggcaattacaaaagctttacctggcagggatcatggggggacgtgccctccccacatcagacctgatgcacagccgtgcattgcagtctgtgaatggagttgcagtcaaggactcagacgtcccgaactgatcatgctctcacacatgtcggcattcctagaccagatgcctccatttggagtccgccttatcaggagcctttggcagaggcctttctcaagcacctgagctaagacctcttgttgccatggtgggagtgggggatgcctaaaaatatttttttcttcaagctgactcagtactcagtacttttctactcctagcccttccctgtcacctcctcctgcccctgggtccataaaatggcaggagcctcttgttcagggctcccttaacagtgagatgatgaagccctgcatccgtcagacccctgttggagccaccccatgtggaaaaatggaataatggaggagtcggtactttttctggttcagtcccttgcttatactatcaaaggcagttattaaagtctgactgttacttttattttgactcgtcttaatcgactactctgacacccagcagctcagctctctctagctcagctgagctcttgaaaaattggaatggcaagctgggtagttgattatgcacaatgtcgtttctgaagagcaaagagcctgaaaatctcgtggggcaattcactaatgatgggtgtaagcagaccttgcagggcactcctggaggatgctaatggattatttgccagagtcagaggatctgaccgggcactctgccagtgagtcctgggaagtgctagcagacctcacgtggcactttaccagccatgccagcaggtctcaggaattgctattgtaagtcacagggtatacttggaggatgatagaaaattgtttataaaagcttttggttccaaggtaaccatcggtcctcctgtttatccccatcacctcggctgagataacctagtggatcaaataagagatccagcagaggggctctaagaagccacagaaacaattccctggacaccgttctctgatgatggggccagaagtcgttggagaccctgtaaactgacctgtaccccaaaactattcctagatctaagcagttccctggggctgacggacaacatgccatgcagcatgttactgagactcatgcttctaataaaaataatgtagagctctttagaatcactttgtccagtgatctcactagatagggtcaatgcccagcagccaagccagaaggaagacttgcttaggggaagaaaccacagagacttggctagtttgcttccattacgaaaaaggtaatcttgttaaataaacttcataaaggaaagtggctccttgaggggtacatcactacagaccccctcctccatagtgccttgatagtggccactttctctgaggaggaggagcaaggtggggagatgagagtgtatgtataccaacgaccatctctttcctcagctgggtactatttggtctctgacagatttggtccacacataatgagtacctagtcactgaaaaacatgtctcaaccaccttcgcagagactatggaggtcctgcagccctcctggtggtctcttgggtctactacgagggagtgggaacggtagatgagaagattaaccagacttagatttacgggtttgttcatgctgctcctgcttgttgtcaagcccaattaagccacctcctgaggtcaagtccatcaatctgcagtgtgatccagatcttaactcagaaattctcaggcacagaagaaatggcttccgataaaatagcaaaatttgacccctcccctccaaaaagggagcataaaaatagtacttgagtgccctcttctggactgtctgggcaagggccttcccaaagagatctctgagtctgattactcaataatggaaccacgaaagcagattgatgggctccccactaaaaaattcagggccaagtaccaggccatggggatttgataagtggtcccgctagagtctgcacagtgatggccttccacctctcctggtggatttggagacaaatcagagatcctgagcaacttttgctctgacactcagctttcaaatataaacaagattaggggttacaaacaaaaatccaaagattttaggggttataaacaagatccttctgtactcaggggacccagaggccctatgccaaggttagagttcaactgaacagtggagaggaattgcacttcttaggccttttagataccagtacacaggtgactgtgatccccacaaacccttgcatcaagatgaggagaaaacagatcgtgttctctgactttgggctcctactaacctccgttgtcatggcccccactactgaatgaaatattggcagtgatgtgttttccatgtgcagccccacttgcctttgcctccaagccctgacaggaattgcaatagttatggccatcttagtgagaaatatagaagaccatggacccatctgatgaccaacacctagtactgttgtttcccaaaaaacaatgtcagctgcctaggggagaaaaagaataattgccatcattgctgagcttaaggaagccaaaatgtttcatgagactgtttctccattcaatagccccatctggcctgtgcacaagaccttggtttcttggagacttaccactgattttaggcagctcaatgcgtaataccacctttggcaccagcagtacctgacattgtgactattacagaggcccaaaacagagagaacttggtatgcagcaattgatattgcaaaggcatatcaaattgtagtccccagtgttggagatggggcctggtgagaggcgattagatcataggggcagatttcccctctagttttgttctaatgatagtgagtaatcatgacatctggctgtttaaaagtgtagcatcggctgggcatggtggctcacacctgtaatcccagcactttgggaggccgaagcgggcggatcatgaggtcagaagttcgagaacagcctgaccaacatggtgaaaccctgtctctactaaaaatacaaaaattagccgggcgtggtggtgtgcgcctgtaatcccagctactcaggaggctgaggcaggagaattgcttgaacccgggaggcagaggttgcagtgagccaagatggtgccactgcactccagcctggacgacagagtgagactccgtctaaaaaaaaaaaaaaaaagaaagtgtagcacctctcctctcttcctcctgctctggctgtgtgaagatgtacctgcttccccttccaccataattgtaagtttcctgaaacatccaagccatgcttcctctacagcctgcgtacctgagtcaattaaacctcttttctttataaattacccagtctcaggtatttctttatagcagtgcaagaaaaaactaatacagagcaatttcttaaaactactcctccctgaatcctcactctcacagccagagacctagttgccatctgcaatggacttaattgtgccctgcctcaaattcctatgttgaagttgtaatccccaatgtgactgcatttgtagattcggcttttaggtgataatcattaaggttaaaagaggtcatagggtagggtcctaatccgataggattggttaccttataacctcataagaagaggaagattgaccaggcgtggtggctcatgcctgtaatcccagcactttgggaggctgaggcgggtggatcacctgaggtcaggagttcgagaccagcctggccaaccaacatggtgaaaccctgtctctactaaaaatacaaaaactagctgggcatggaggcacacccctgtaatctcagctactcaggaggctgaggtaggagaatcacttgaacctgggaggcagaggttgcattagtaagccgagatcacgccactgaactccagcctgggagacagagcaagactccatctcaaaaaaaaaaaaaaaaaaagaagaagaagaggaagaggaagattctctctctctctccccttccctctctccctcccccctctttctgtctactggaatgtgaaaggaaaagccagtgagtacacagagagaaggcagccaactgcaagcaaggaaggtgactctcaccaaaacctgagctcactatcatcctgaccttagacttccagcctctagaactgtgagaaaataaatttgtgttgtttaagccagccagtctatgatattttgttgtagcagcccaaacagactaagacaccatccatgataccttcttctttctcagccccacatatattatgtcaccatatcctgtgtgcccttccttcaaaatatgctctgaatctggttacttaccacttccactgttgccacccataaccaaactgctatcatcagctcttccctaaacacctgcaatagctccttactaggctcccgcactcacgcctgattccctcccatctgttatcttcatattaaaaataatacagtggctttccactataccctaggatgtgatttaaaattcttagcatggccttcaaagctttgcctaatctatctcctgcttaactcttcaaactactggagcctctcttctcctcactcctcaccatctagtcacatggcccctttgggaatatatgaaaacttcccagcttggaatcactgcccattatctttcacctggctcattcttgtttatccttcaggttcagctttcatgtcccttctttggagtggccttccatgacctacatcctaaattagaagtctttgtattctttctagttttagcatgttctttacattgacatgcataccaccagttttgtatgtattggtttattgtctggctccccagttgggtgaccaatttcatgagagtaaggaaagcatctgccttgttcactgatgttattaccagcacccagcctagggttcaacaggagtaggtgctcagttaacgtgcgttgagtgagtgaataaatgaatagagtctatgaggttggtgtttttagttcagagtagtttggtgattcacttgctgccacacagctagcaagcagacataaatgggcaagatcccagaatcatagttccaaggtgaatgcataatcaagagactgccagggggtgaaaaatggaagggggcatggagtgtgagacaggtgaaaagattccagaccattgattctagggagatcttcccccagggtgtgtttttttggggggtacatattcaatattcacatttgttgaaaaatagcttctgatttcataataaatatatattgctgaaagactattccggttggtaaggataacagaaaatgcagcgtttcttcgctgagggcagatttttttcagtttattgaaaggaggcaagttaaaaacgtgactaggaaactgcacgaaagctttctgccattcccctgattggagctaaggcctgtggggtgcaggagacaccaaggtttgggtcgtgccgggactatgctcatatagtggagagtaggtcttggtgacacagcaacccacaggctgcacattgccacccacccctcaccccagcaaactgcacatcattccgcccctaccccacagactccccttcacaattccctaatctgtatattacctctcaggctccacacatgccccacgccagcccccctctccaagctccactttaccccacattacctcctagaatcacatcaccccacaaatggtgagaaatggccatttgtgaaaagcgagtttggaaggtgctggtcaggagagccgggtgcgaagccagaacccttgggcagaggcagcatgagggtcaactcgacagcagaaggcgcctgagagtctctccgcaaaggccatgcaaggacgcgcgctcctgtaagtacagcctccatgcccgggttaattcctagacaggtagtgagccaatcaagccagccacccactttctaaaaaacaaaaaatctactctttctccttgccctcctctgctcagcatcgttcactatgcctcgaatattttaaatggccctatggatatctgtaaaacaaaggctagtagttatcattattattatcattaatcagatatataggtaaaaggtgaccctaggaacaaagccaagaatctagagtaaggatggctaatggggattgtgtttgaatagtttgcttttgtttcttattttgcttgggttgtgacgtgtgttgcttcaacatatggcttaaaaaaaaaaaagtctgttaatgtattggtcacaaagtgtctttctgggaaaaggcacttattttcccagagtgatttgacacatttctggtgaaatgcattaacattaacgttcctttttttttccccaagttttggacatatgggtttaattacctgctagattagcagatggaaatatgtggtaaatggatgtaaacaaggtgcataaacttaggagagaggcagaaatttttaaactttaggtttagacattcactagattggacaatttttaacatttaaaataaaactttttgccacaaagaaacaattgtattaaaactagtttccagaactgcccaaatgactttttaaacatgatttaaatgtcaagctttctttggcaaatctatccaaaatactaattttccttctagaacttggtttataatttatatattagagtgcccttaattgatgttcattgggataccttcctctgagccctaatggtttctatcttccctttaaaatgattaagtatcttttaattaagttgtcattcgcaaagatattctggagcaaaaatcaggaattaaacatctatgaattcttcttcacttctgttatagtgtagcaatttatcttctaacccatagtagtctatcaattgagtaaggcttagtttcttgttctcttcagacacagctgactgcaactcataaagcaacagctggctacagctcctccacttctttattaacaactgtaatggagacagattctttgatcatacagtttgatgagttttagcctccaaagaaggtcttctttctcctgaacctgcttcaccaatttggctttttcatcgtttaatctttgtttagaaagattctcattcacaaactcattttggagagcactgcatgacccagagtcaaatgactgagattcacagacattgattcttcaaagtatttttcaaatttatattttcttcaaattcactgtctatgtgtttaaaactttcttgaaattccaaacagttttcctctgtggaagatgctggtttctctgaaaaggtctgatcgttttcttcattctctactttaagaagtttcaccacattataacaggaactaaatgaagatcttgctttccttaatctttctctaagtgttgcactcataggttgtgttcgtgaactatttgtatagggagatgatggattcacagaggtctgaggagtgctaggtaaaaccacagctgagtctgatggactttccatcttgaaaatgaaatcttggttttccttcaactccacagcagactcccgaggaagtccaggtctcaggcatcccccttcccctcagcagggtacctccctccgccatccccagagagagcaaaaagccaactttcccttcttaaaggactcacgggaagggaataatggaaataataacttcacatgctgaagaaaacagataaagtgtgaagaaaccatttatcaacatttaaacctccacacattatttgttctttttttaaaagaactttactaagaatcagattcattaagtcaaaggatgttagaacacaaaggaacctgcaaaattaaatcgcgttcttattatataaaacaggagacccagagagggtaagtgacttgtccaaagtcacagagcacttgaatgcagtcagggctgatttccagtctgcaactcaaaagagaagcagtgtttctcagtgaaagaacagtggtgtgagttttaaagattttattctattctttattacatgattattataggaaaaattgggacacattttaaattacctagaatcctaccacttcacaatgatcattgttagtatttttgctgtataattttccagactttttaatgtatatgaatactggtaaatgtgtttactaaaattggatcacactgtctgtacatctctgtcatataactcctaacagatgcaaaactagtccactgaatagattaacttcatcagtttaaccagtcccttactgatagatagatagataagctttttcgaatgttaaacccttataaaagatgctgcactaaccattcctgttcagacatcttttgctgaagtgatttctacctactgatcagtgtgaattttgtagggatgcaatgatgtagactaggtttgaactctggctctagaacttactgtgtgtctttacacaaatcacaacttttctgcactctagtttcttcatcttcaagtgggaataatcatactgatagcctagaggtgttaaaaggattaaatgaaataatacatgtaaaatagttggttaatacctagcatgtagcaaatcctaaataatattagttattattattaccacaatgctgaagaaaactggctcttcaaaataatgcccatgattttctgttactctttaaaagagactagccagaattttacaaagaaggttttagatgcaaaacttcagtagctaaattaatatttccttttttctaacttaatctatcgagaagaaaagtaataaatttaaatcatgtgtggtctgttgagctagttactatgttctatctatataacttaatgccagtcaaaatttaaaaggcatagcttttcatcaaacattcttgtcttagtctgttttctgttgcctataatagaatatctaaaactgcataatttataaagaaaaggaatttatttcatatggttatggaggctaaaaagcccaaggtcaagggactgcatctggtgaggaccctctagctggtggggattctctgcaaacttcctagacagcacagagcatcacagggtgagggggctgagcatcctagcttgggtctctcttcctcttcttatgaagccaccagtcccactcccatgataacccattaatctattgacccattaatccatgatggattagtcgattcatgagggcagagcctttatgacccatcacctcttaaaagccccaagaccccacctctcaataccgccacattggagattaaatttcaacatgagttttggagggggcaaatattcaaaccatactcatttgtaagtaaaaaatcaactgttttgtgataaagttgctcacctttctttcccctttggaaaatgctcaaagcatggcttaccccataaaatcagcagaatatctttacagtcatctatccagcctcccggtgccttcaagctattctccactgcttttctgttttatccatgggcccccagctatttcatattcctcagaggggtgggaaagagcacagaagctgaagttttcacctctgagactttgcttttaaactgaaaagatatccattgtcacactgggattcatttctatctgaagctttggaaacacatcacgacttttaccaaagcctatacagtgaatctaatttatgtgtcacctttatttcaccaatagttgctttaaaaataagggaacactcaccccctttgaaaagctgggtggaaggttcagtgttgtatggcttatctcggaagtcaggggtcagtgaccaaaattcacggtgaccagaagcattccaaaatgctgccagtaactccatgcttactgtttcttcctcttctgctctactgaacattgtggacatagacactcaggattgttggggtggatgatactggttaaatgagtccttcttggacacagctttggttgaatgtgagcaccaaacactgagaagtccttgtctataactgatgtgcagaatgacccatacgttttttggtttgggattctttttttttttctctactgtgtgttatccttttctctaatagtggccagtcacattctaccagtctgtatttgtctcacggttgttgaagtggctttgccaacttagctaagctagaaacatagtttcctggaattgccttcccaatgtggttctgagttagagtggaccaggagaaaaatttgggcagggcttgggaagtgggagtgaagcaatagatactatattctgaagtttggtaggacaggcactattaccactgccatacactggcactgatcaactggcacacctcgttggtgtggggcagcaacaggacctgcagcaactccaactctgacaagatctccttcttcaacttctccaagtcctaagtcaggtttgtgtgcacttccacgactatggatgccagctctttctttaggttggaggcaataagagacagatgcaggttccagtaagtcttcatgggatttagtttgtcctagggattcaagttaatccttgcaggttccagtttgtccttgctttcccccacaccacatacacctcttcttcccaactgtgggccctgaatatctacagtgacctcaggctgctataagtgcagagacaatagccttctatagacttcttcctctgtgtaaggtacatggatgttccttggtcaaggaataggccaaggtggatatccaggcctgcatgactcagtgagtttggcatgcaggcacacacctccacttgttatataacctgtttgtgtaagtttatacttcgctctaagccactattgtctgtaaaaggtataactgccctgctaacgttctacaggggctcttgggactctggttagctcaacatggcttaacatggtgggcacgctggtgcccagagaaagaaagagagagagccaaagctgtccgtcttgcagatggacaggagggagccagcacacagcttggcttgctcatgcccagagagaaaaagagttaagccgctgaccctgaaggcaaggaagagccagatgcacagctgtttgtgggagccactggctcaagcagctgcgacagggcaaacagtgtgagagagctagtgtgagaaagctgttaataaaagctgctgctgaataaaaccacattcacctgccttcagccccgagtgttctttctgctcatccaccaactccctctggacttcagcatgggctggacccggaccccgggacctgacaactggtgatgagaatgggatgaggtgagttggccccagtccctgagggctcccaggttggctttgtggccacagcatgggctgtgatacccggtggcagctgtgctgcgaagatgggctccagtggaaacatgggaggcagtgggtgggtctcctgtgagtatggagaaggcactgaagcacctggaagtgcacagcactgagaagaagcatgcctttgctggcagagtcagatgagcgtttgtaactgtgctgtgggaagttcatgcccagtccttgtggaactcagtgcagtgaggaggaagaacctccatggcaggcttgcccagtgatccaccacaaaatagatcatgagcagctactgggccccacgagtaggcccagagaccccctgctgtggtggagcacccttcctttggtgcctgtgtccctgctgagttgagggagttaagcaagtaatgtcggcagtcatgcacagacttagtgcaagccatttgggagaaggaccttgctgcgcaacccagtcctgctcgagcattccagttcaaagagtacctgctgcagttggtggaagtgtaaagcctcttctgtttgataagagaactggccgagatgcccagcttggagggcactggacaacgggagccacatttggacttcgcaatccactggtccctgaacctggataagtttccaggcagagctgcatttattgacaactatgaagactggtcagtgaaagtgaaacctgtatctctgcatcttggcatcgactgcttggctctctgcttatgtgctgtgtatgtctctccatccatacctgaagacattctggggtagatgttttgcatggcttggcagctgtgccatctatcacagacttaatagaccacttgacaatggaacttggcagtgccactgtgtggtggacttggctaatgcattcttgtcaatcgacaatgctccagagagccaggaagagtttgccttcatgggacagcgacaatggactttcacagtgttgctgcagggctactgtatagccccaccatatgttgtggttttgttaataatgttatgttaacctctgattctcttgcaggtttaaaagtggcagtgtccctcttgcctgggattggggtgatgaggctgagacagcctttctgggtagtaaaccagggtgctcatttacactgaatgtgcatgtaaccacagataattttggctagggcctatagcagtgcatggagcacttggaagcaccagtgggctgttagtcccaactgtggaagggagctgagctccagtgcttactaatagagaagcagttattaatagtgggatgggtgcattcatgggtaatgaccccctggacagaggcagcacagacatcaactttagcgaagtggggtaccgacttgaaacagtgaagtatgctaagtaagtacaaatcccttagcagcaaagttgcaagaggtcttgggacctgtagtcctaatgcaagataaggccatggggcctgaggcactcctaaaccctgagacttcatcattaggaagggcatcccctcattcctgatagggcatggcacacagctaggtctagctggggtgctactgctgcctggactgctggtgcggtccagcctagtactaacaccatatggtttgaaaccaggtgtgggcaaagcagctaataagctaaactcagggcagtgtgaatggtaatcaccaaggatgtgacaacctatggtaatctgcgccaatagctgggcagtttatcaaagcttatgtatgtaacgggcttgagtgcccaaaagcttgtgtatgtattgggcctgcatgcccaaagcttgtgtgtcaggcttatgtgtcaagcctgtgtatatatcaggcctgcgtgcccaaagtttatatgtcaggcctgtgtgcaaaacttgagtatcaaacctgtgtgcccaagacctaagtctccctcagcctagggggtggagtgtaaggtacatggatgtgctttggtcaaggaataagccgaggtggatatccaggcctgcatgactcagtgagtttggcatgcaggtgcacacctctgcttgttatataacctgtttgtgtaagttcacacttggctctatacttggtataaaggtatatttgccctgctaatgctgtacagggctgttggggctcagctcggctcaacatgggttaacatggtagtgggtgcgctggtgcccagagaaagagagagagccaaaactgtcagtcttgcagatggacaagagggagccaggacacagcttggcttgctcatgcccagagagaaaaagagttaagctgctgaccctgaaggcaagggagaactggctgcacagctgtgtgtgggagccgctggctcaagcagccaagacagggtggccagtgtgagagagccagtgtgagaaagctgttcataaaagctgctgctggccggg[131 bp omitted]gggcgaggtggcatgcgcctgtagtcccagctactcgggaggctgaggcaggagaatggtgtgaacctgggaggcggagcttgcagtgagccgagatcgcgctactgcactccagcctgggagacagaccgagactccgtctcaaaaaaaaaaaataaataaataaaataaaataaaataaagctgctgctgaataaaaccatattcacctgcctacagccccccgaatgttctttctgctcatccacccactcctccggacttcagcatgggttggacccggaccccaggacctgacaccctgctcccacaattgcatatggtctgattcctgtaatcatcccttattgcttttcactctgcttctctgatcaaactctgcaactatgttcaagtgattcttattttacatccaaatttgcaaatcagacacaggattatagacattacaaaaaaattcaattttgaaaaaaaaaggaagagatttgtatatgacacttaagtaacccatctattaccctcgctttctttttgatgtcaaactcctttaaatggcaccccaagtttattgcaaaagtatttttcttcctcccattttctctgcagttccttgaatatgactcctgcttttaaaatgctattttaattcatcagaaacttataaaacatcaaatccagatcttagtccactttatttctttgtactcttaacactgttgactactctcttttttccctcattaaatttggtttcaatgggtctcaaatttctgtgacagatttttggtcaagttgtttccactaaaaagtgctgattttaaaaattaaataacttaaaactaccagatgccaaaaaaaaaaaagttcacaaaacattctcctttccttccaaaggttttacaatgcattgttatcattaaccagtcttttacgactaaacttaagtggccagttgaaacaaacagttctgagacccttccaccactgattaagactcaggccaggcaccgtggctcatgcctgtactcccaacattttggaaggctaaggtgggtagatcacttgagcccaggagtttgaaaccagcctgggcaatataatgagacctagccaggcatggcggcacatgtctgtagttccagctacttgggagtctaaggcaggaggattgcttgaacccaggaggcagaggtcgcagtgagcagtgattgtgccactacactccagccagggcaacagagtgagaacctgtctcaaaacaaaaaacaaaaaacaaaaaacaaaaacaccagacaacaacaacaacaacaaaaaagactggggtggcatgtattagggataatattcatttagctttctgagctttctggacagacttggtgaccttgccagctctagccgccttcttgtcctctgaacccatggcaactgtctgtctcagcgaatttggcatgcaggtgcacacctccacttgttatataacctatataacctgttgtataagttcatacttggttctatccttggtataaaggtatatctgcccgcaaaatgtcccagaagagaatagtcaggatagtcagaatattcagagaagctctcaacacacatgggcttgttaggaactatatcagtcatggcagcaccaccagatttcaagaatttagggccatgttctagcttcttaccagaatggtcaccttttctttctgctcagaacacttgtaaggaatttgagatgtgtgacaatctagtgcaggggcatagccagcactgatttggcctagatggttcaggataatcacctgagcagtgaagccagatgcttccattggtgggtcatttttgctgtcaccagcaacattgccatgatgaacatctttggcagatgcgttctttttttttttcttagaaagaatgtaatgcatgtttttaatcagaacaacagcaataacaaaagctaagtatggatatgccaatgtagtgttgaatccagcaatggacacaaataaagagcaaatgcttgacagagacagctgtaaataatctatgtacctcttacatccccccacttcataaaaaagacattctctttggaaatatggttacaaatgtaaatcactgatttcttgcaagaccacgatgattctgtaataaatatcaaattgttccatttcagatttgtaaaaggattctttcagatatgaagacttgggagcaactgtgaagctgtctttattcagatgctttgaaatataaagtggtgatcttaaaccaccaagaactgtaaggcatgctaactgatgtttataacaacttagccttcttttcctttatatccgattttattaagtgggcaaacaccttgttcacattgaggcccacattgtccccaggaagagattcactcaaagcttcatggtgcatttcaatagactttacttcaattctaacattgactggagcaaagctgaccaccatgccaggtttgagaacaccagtctccgctcggcccacaggtacagtaccaataccaacaatcttgtagacatcctggagacacagacacaagggctcataagttggatgagttaatggtagaataaagtccagagcctcaagcagcgtggttccactggcattgctatctttataggtgactttccattcctagaaccaaggcatgttaccacttggctccagcatgttgtcaccatgccaaccagaaattggcacaaatgttactgtgtcagggttgtagccaattttcttaatgtaagtgctgatttccttgtatctcatctggtggtagggtgactaagtggaatccattttgttaacaccaacaagtagttgtttcacacccagtgtgtaagccagaagggcatgctcctgggtctgcccattcttggagatgccaacttcaaattcaccaacaccaggagcaatgatcaagagagcacagtcagcttgagatgtgcctgtgctcgttttttttttgtttgtttgttttgtttttttgaggcggggtcatgctctgtcccccaggccagagtgcagtggtacaatcttggctcactgcaacctccacctcccgggttccggtgattctcctgcctcaacctcccgagtagctgggattacagacgcatgccaccacgcccagctaatttttgtattttcagtaaagatggggt[145 bp omitted]atcaatgataatcatgtagtacttgctggtctcaaatttccacagggaaatatcagtggtgataccattcagctttcagtttatccaagactcaggcatacttgaaggagccctttcctatctcagcagccttcttctcaatttttcagtggttcttttgttgatgccactgcatttgtagatcagatggccagtagtagtggacttgcctgaatctacatgtccaatgacgacaatattgatatgagtttttcctttcccattttggtttttaggggtggttttcaagacaacctgtgttggcagcaaacctgttgcagaaaagctactttctcttttctgaatttctctcttcccttggtttctatgacaagcactctttggaattttctcctatctctccaactgctgctccctgtcttagtatgctcacttctcttctacccaatcgtcaaggtgtaggagttggttgctcaaagtccagttcttggcactcttgaattctcactctaccctctctacctttatgaccccctccactctaaaggattcaaccaccatcccttcacactcatgatttatagatctatgcttttatctcagctttctctcctgaatgccaaggtcatgattcttatagtccatttagttgcagatgactctcaaattcaacaagcacaaactgacctatttatttaccatgacatgttccatgtcccctaacttggataatggcattacaattcttcagtcactcgttctcaaaacttcagagttggggagtgatgtcaccaaagatggagtagaagcaatctggattcactccccctgcccactgaaaaccaaaaacaactatccggtgccacaattatcaccagcaatatcccagaactcaaaatcaaagctgtgacaatccctgaggccacagagaagtaaaaaactatgagctgaaagtgagagaaatggacttctctatccacaatgcccctcccccaaactactagacaccacatggaaaaatcctccgagactcatggtttctacattggaaaaagtgagatcaaggtggaaagccagcttccccatcatcttgggttcctatgcaagaaagctgttcctgcctcaactcacaggaagcatcacaagtgcctccacctaaggacaggtggagacaaaccttggaggtggagctgcatggcccagcaccagaaactcggggggctgctctccactctagaaaaaggggacaccaaatcagagaggtggtttagcagcaccacactgtaggaggcaccctgcagggaacctctgggcatgaacccgtagccagcctccccacacagctgaggagtcccctttggaatctccccctgtctgtaatgggcagcacttggagagctacagaaaacctgtgtttagggcgccatctagtgctcaaagaaggcagcaatctagggctaagggaatcaacgggcaaatcgcacagaacctctaaacacacaaaacaactcagacaggaaagacttgaaaaaataaccaattctttaatgcgaagacatagatctacatacataagaaataacagcaaacagtgaataatgacctccccaaatggacaaagcaaggaaccactgatcaaccccagtgagagagcaacatgtgagctctcagatagcaaagtcacaggagtcagatcaagaattcaaaatagcagttttgaagatactcagcaatctccaagttaatacagaaacgcaacttagaaatttatcagagaaatttaatgaagaaatggaaataagaaaaaatcaaacagatacctggaactgagaaatacattggctgaactgaacaactcatcacagaggtatcaacagcagaactgatcaagcagaagaaagaaatagtgagctcaaagatagtctatttgaaaatacacagtcagagaagaaaaaaagaaaaaagaaggaaaaggaatgaagaatatctacaagaactagaaaataacttcaaaagagcaaatctgagtcattgaccctcaagaggaaattgataaagaaaagggggtcattagcttattcaaagaaataacagaaaactttccaaacctagagaaagatataaatatccagatacaggaaagtcaaagattaccaaacagattaaacccaaataggactataccaaaatatgtattaagctctcagaggtcaaggacaaagacaagattctaaaagcagcaagagaaataaaagcaaataacacacaaaggactttgatttgtctggcaacagactctcagcagaaacgatacaggacagaagagagtgagacgacatattcaaagtgctcaaggcaaaaactgagaataatatacccaacaaagctatccttcaaacatgtaggagagataaagactttctaagacaaacaaaaggtgaatgaattcatcatcaccagacctgtcttgcaagaaaatgctagagagagttcttcaatctgaaagaaaaggatacgaatgtgcaataataaagtcatttaggctacgcatagaggcccacacctgtaatcctagtgctttggggggcactaggcacagaaagacaaacatcgtattttcttacttatttgtgggatctaaagatcaaaacagttgaactcatggacatagtagaaggttgattaccagaggctgggaagggtagtgggggataggtaggggagttggggatgattaatgggtaccaaaaaatagttagaatgaatgacacctactatttgatagcacaacagggtgtctatagtcaataataatttaattgtacattttaaaataactaaaatagtataattggattgtttgtaatacaaagaatgatcacttgagggggtggataccccattctccatgatgtgattattatacattgcatgcctgtatccacacatctcatgtacccataaatatatatacctactatatacccacaagaattaaaaataaaatttttttaaaaagtagaaagacttcaaataaataacccaatgatgcacctccaggaactagaaaagcaagaacaaatcaaaccctaaattagtagaaagaatgtaacaaggctgggtgtggtgacacctgtaatcacagcactttgggagactgaggcaggatgattgcccgacacccacctgggcaacaaagtgagactgtgtctacaaaaaaagtttgaaaattagccaggaatgatggcatgtgcctatagtcccagctacttaggcagctgaggcaggaggaatgtttaagcccaggtggttgaggctgcagtgagccatgatcgcaccactgcactccagcctggggagcagagcaagattctgtcagaaagaaaaagaaaagaaaagagaaaaagaaaataataaagatcagcacagacataaatgaaatcgagattataaaaaaatacaaaagatcaatgaaacaagtagttttccaaagagataaacaagcaaaactgacaaatctttaggtagaccaagaaaaaagagagaagacccaaagaaataaaatctgaaatgaaaaggagacattaaaactaataccacagaaatatcacagaaatataaaggatcatgagagaccattatgaccaactatataccaacaaactggaaaacctataagaaatggttaaattcttggacacatacaaactataagaaatagaaagcctaaacagatcagtaacaagtaatgagatcaaagcagtaataaaaagtctctgatcaaagaaaagcccaggagcagatggcttccacaatgaattctaccaaacattttaagaatataaactctattcaaattattccccaaaaaattgaacagtagggaatacttccaagttcattgtatgtggccagcattaccctgacaggaaaacaagacaaaagatacaacaacaataacaacaacaacaacaacaaaactacaggccaatattcctgatgaacatagatgtaaaaattcccaataaaatactagcaaaccaagttcaacatcacattaaaaagatcattcaccatgatcaagtgggatttgccacaaggatgtaaaatggttcaccatacacaaatcaataaatgtgttatatcacattaacaaaactaaggacatttttgtccatgatgatttcaatagatgctgaaaaaagcattcagtaaaattcagtatcttttcatgacaaaaactcaacaaactgggtatagaaggaacatatctcaaaaccataaaggccatatatgacaaacccacagctaacatcatgctgaatggggaaaaattggtagtctttctggggaaaaattggcagtctttcctctaagaaatgaaagaagataaggatgaccaattttactatttttattaaacatagtcctgaaagtcctagccaaagtaattgggcaagagaaagacctaaagggcatccaatttggaaagaatgaaattaaattatccttgttcattgatgacatgatcttatatctagaaaaacctaaagactctaccaaaaaattattagaactgataatcaaattcagtaaagttgcaagatacataatcaacatacaaaaatcagtagcatttgtatatgctaacagcaaacaattggaaaaataaatcaaaaaagcaatcccatttataattgctacaaaaaaatacctaggaataaatttaaccacagaagtgaaagatctcttacaaagaaaactatgaaacactgatgaaataaattgaagaggatacaaaaaaatagatatctcatgcttatggattggaagaattaatactgttaaaatatccatactatccaaagtgatctacagtggtctcttcactctattgattgtttcccttgctacccatacaatatgatacaaaatgatctacagattgcaatccctatcaaagtgccaacaacattcttgatggaaatagaaaaaacaatcctaaaattcatatgaaaccacaaaagaccccaaatagccacagcaatcctgagaaaaaaagaacaaagctggaggcatcatactacctgacttcaaaatatgctataaagccatagtaaccccaaacagcatagtactggcataaacgcaggcacatagaccaatggaacagaataaagaacacagaaataaatccacacatttacagccaactcatttttgacaaagatgccaagaacatatattgggaaagaacagtttcttcaataaatgatgctggggaaactggataaccatatgcagaagaataaaactagacccctgactctcactatatacaaaaatcaaatcaaaatggattaaagaaagccaggcatggtggtgtgtgcctgtagtcccactacttgagaggctgaggcagaaggactgattgcttgagcccagaagttcaagtccagcctgggcaacatgatgagaccccctatctcttaaataaagacttaaatgtaagacctgaaactataaaactactggaagaaaatgctgaggaaatgcttcaagacattggtcttggcagagatattttgtgtaagacctctaaagcacaggcaacaaaagcaaaaatagacaaatggcattacatccaggtaaaaagcttctgcacagcaagggaaacaatcaatagagtgaagagacaacctatggaatgagagaaaatattttcaaaccatatattaaataaagggtgaatatgcaaaatagaaaaggaactcaaataactcaacagcaaaaaataataatctgattaaaaatgggcaagtgatctaaatagacatttctttttcttttagatttgccgttaacaatgaatatatatttcttaaaagaagacatacaagtagccaacagatatatgaaaaatgctcaacatcactaatcagggaaatgcaaatcaaaaccacaatgagatatcatctcaccccaatttaaatggctattatattcaacctgagaaaactgataaaaatggctattataagacaaaaataacaattgctggtaaggacgcagagaaaggagaactctcatacactgcagatggaaatttaaattagtacagccattaatgaaaatagtatgaagtttcctcaaaaaaacaaaaaaactaccatatgatccaacaatcccactgttgtgtatatattcacaagaaaggaaatcaatatattgaagagatatctgtactctcatatttattgcagcactatgcataatagccaagatatggattcaacctaagtgtccagcaagaaatgaataaagaaaatgtggtatatataccacagtgaaatattattcagccataaaaatgaaataaatactttcatttgcagaaacatggatagaactgaagggcattgtgttatgtgaaataaaccaggcacagaaagacaaatattgcatgttctcactcatatatgaaaacgaacaaacaaacaaaaaaaggacctcatggaggtatagaataaaatagtgattaccagaggctgtgaagggtagagggagggaggatgaagagaagttggttaatgggtacaaaactacagttagaagcaaaaagttctagtgtttgatagcacagtagagtgactatagttaacaataatttattgtatatctcaaaatagctacaagagaagatttggaatgttttcaacacaagtaaataataaatatttgaggtgatggataccccaatgacccttatttgatcattatacattgtatacatgtatcaaaatatatgtacccccagaaatatatgtacaaccattatatattaattaaaaacttgagttattcaatacttttccctctaatcagactcctaactttagcttccacctctttttctaccccctaaagcttgtgtttccttcccaaaacatgaattggcttatgtaaattctttgttcaaaatatctcctggttcccagtggcatatagaatacatatctgccagttttgtacagcatagccacattttgatttcttccctttcaactgtatgtcctactatactccaatgtccctttcatcacacacacagtctgtggatctccctcagcactcccccatcttctggatatatctggatgctcctggcccaggggcttggctcagaccttttctgtttgagttatgtactatattgaatgcctaaccatactccctatccagtttcagttttcactcctagctgatgacttggataagagtctcttgagttagaaatagtttttatcaataacatgggagtaacaatgcatataatagcaatagctcacatgaatcaagctcttaattactgtgccaggcactgttaatgacaaaaatgataaatgtcctccaggataaagggacctaagagacagtttgatcaaatgtccttacaccctcaaagagggtttcctgatataacaggtccagcctctgtctacttgcccttttctattccaacttgtcaggagaagaggggccataccctgttaagtccagtgagtagaatcacttcattcatcaaggcgggacgtggcttgtttatgcatgaggtagttattccactctggtttaatttcttttaaaatggggatgatgacaattgtggttgttgtacagataaaaactcatgtacagtgtcaagcataggacccatggttaagagctattaatattcagaatattaacacatcacagggtacctgtaaaacacttcttaaagaactacagtgccttcaacctagcctggctcttatttatttgacacttcagtggggaacaagaattcaattttggccaggtgtggtggctcacgcctgtaatcctagcactttgggaggccgaggcaggtggatcacttgaggtcaagattcaagaccagcctggccaacaaggcaaaaccacgtctctactaaaaatataaaaattagctgggcatggtggtgcacatctgtagtcccagctattcaggaggcttaggcacaagaattgctctagcccaggaagtgaaggctgcagtgagctgagatcgtgccactgcactccagccaaggtgacagaatgagaccctgtctcaaaaaaaaaaaaaaaagaattcatttcaggaagatagttctgagaggcgaaagaagaggagaagcagggaggagtgggaggatgaggtagcagcagtacccacagtgatgcaggagctcctggatgggaacctggagggcagtggtgtttttattgcctcttccatgattagaaaataagttttgaactttgggggctttaaggagtggaaatgagaaaagtaaatacagaggctgttagcccttcttaagggagaatactactgtcttctgtgtatcttcatgttgggactcagtctgagctggaagtattcaaattaatgcactgaggagctggattatacaaaaattagctgggcatggtggcatgcacctgtaatcccagctacttgggaggctaaggcaggagaattgcttgaacatgggagtcagaggttatagtgagctgagatcacgccactgcactccagcatgggcgacagagcaa[131 bp omitted]aaaccctgtctctactaaaaatacaaaataattagctgggcgtggtgacaagcacctatagtcccagctactcgggagttctgaggcaggagaatggcgtgaacctgggaggcagagcttgcagtgagcggagatcgcgacactgcactccagcctgggcgacagagcaagactccctctcaaaaataaataaataaataaataaatagggttcaattgtacttaactatttgaagtatttaaaaccaagcataacctctgagctaaaatgagtgattttgtaaatatttaggcagtggtgtgaggaagtaattcacccccaaaacacactaatgtacatttagttataatgagactgaagcagggagatgaaggccaagtccttctgctgttgttcttaagcctttggtaaagcaacatagggagtggcatctttagatttgtctaaaaaaaacaaagaacagttacaaataaaattccatgcacatgtatcccagaacttaaagtaatatatatatatggcaaaaaaccacaaaaacaaataaaattccagacagaaagacgatgcaaatattagagaattatacacaaagtatgccttgcagctgccacacaaactcaacattatgaaactatcaaatgcacaaatgaacactctcttgaggaatttctaatatcaaaggaattgttttcttcccttttggtggtacaattatgaagaggtgggttttgcagaatttgtttagtggtggtagggtggctgtcaattcagggttgattcaaacctctgttaatttgaaatactcttccattttctccagtagtgaagacttatttgtaggtcatgagatcaaaaggtgactacctgagaccgtggaaaacctaaagttgtgtcaaagaactattgccagggaaaaaacatcaagatgagtttattgttagttttgctgcagagagagagagagagagtgtgtgtgtgcatgcagtaatggaaacatgtgcagatctgatggtgggttgtccaaaacaagcagcccctgagtgctgtcatcctaacaccataggtagggctcacagtccgtcttggctgactcccacagtcaggttgggaggatgaaagaaacctccactatctcaggaggcatggaaagctcagaggaaacgaaagacaaggtttgatgagctgcttttctggttttcatagtggtctcttaatagaattctgaaaaggaaaaggagccacaagaaaaaagagaaagaaaatgttctcatctatttccaaattctaaggcatgaccttcccccaagaaactcttggtagatgttttctccctttctcttatttgcaaatataatagaactgttttatgtaatcagtactgggaatagggaactaatattggcccataaaacagcctactttggggatcggctatttagggagatttgataatagatttgaacatgcccaaaatgagctctattacactagccttctttagactatattcatgcagagaaaggatcctaaatcctaaaataggagagtgaaagtgaggagtcagacagggagaaaaggcctgtagtgtcacaatttgcagattgggaacttccaaaaggattaaatacaatgttaactccattaactaggatgctgagtagacgtaaagcccacctgacatggttgttttgttctgttttttagtagctgccaggcatttaagaaaaagccttttctgtgaccccccacacccacattgatgttgaccttgcattaaaatgactagttctgttatgggatctttggagtgtcaattttctggccagaaacctctgtggctggtgacatctttgccctagttcttgtcctgtgtccaggaagaatgaggtatgcgacaagtgaagagtgaacaagacaaagaggcgcctgagttcttgtcctgcatccaggaagaatgaggtatgcgaacaagtgaagggtggacaaggaggaagaggagctttattaagtgttagaacagctcagaggagaaccacagtgagtagctcctctctgtaagcaggtaatcccatctctccatcctctgccctgctctggctgagcccagaacttctagggacctcagaggggaggaagtgtgtgctgattgttccatgggcagccatgggtgggcccagaaaaggcaccacaggtcctcactccagtcgtcaggactggccgcctggcctgaaggtggggtcttactgaggacctgccctcttccacccaggagcctgtctgcctcccacagcagtccatggcgcccaggctgcttgcaccaaggggcacttgcaggccagtgctgagctgccctcagccccccttagcttcctctctcatgttcgtgggcactcaaattctggagggggccaaggcagcagggcactggcatgtcagcactgccctgagcctacacacatcctccgggctgtgacagcacctccggctcggccccaactcctctctgagatgagatcagagcaggtgcctgagggaaaagagaacaggcagtgggagcagacacacctgagcctgtggtggtggggcttcctggcccccaaggatgcaggctgcagagatgcccgtgtcctgcacctgggagggtagctacagatgcacctgaggagctcctgccccaccaacttggaaggggtggggctcccacttgtccctggctcctgcccgctctgtggagccagaggcctgggtctgcagccacggattgggcagttatagttgcactcaggaggacagggatcctgcctgctcctggctccctcgaagagcacagggaggctcagatctgcagcccagtagggtcggggctcctgcctgatccatggagctggaggcccaggtctatagctgcagtttaggcgactgcagtggcacccgggaagctccctccccaacctggaaggggtggggctcccaccagctccatggaatgtgcagccccagccatgcctccctgctgcagccagcatgattgcagcagccgctgccatcagttctactttcctgccttagaaattggtgatggtatagcaggaattttaaggaatcagagagactgatggggttcagggggatatttattaattatttaggtgcaccagcccagttggattaacatccaaaggactgagccccgaacaaagagttaagttaccttttaagcatttcatggggtcgggggagatctgtgcagggggaagcgagaaacaaaggcagttattcaattgagacatgcattacttcatttcttactttttaaggaaaaacatgttttgtgaattgagtttatctgtctagtgaccttgcagctgcacagctagggaatcagagtcttcacaatgcctgggaagggaggagagataaggctcactagccacagaaaaataggcagttagtttttaaaggactctagctctttctctttctcagagggaattgggttttcttacgtacaactgaatttctgcttacatactctttaatttcttttaattcctgttccaatgggaatgagatctcctagttttggactggggctagcagggcctcgggtgcaccaccacttggcaacatcagcctctgtccagaatcctgaacctgtaagctagaacagggttagctgacagtgtcctgaacccaagaaggttgggagggtggggttggattggagtatgcaggattgacaatggtatacctcttctccaaactactggctgggcagaaatcttgagttctaatgaatctgaacctagttaggctaacctttccttagcacctttccttagcagtaaaggctaaaatatcaagtcagtatccagggcttcagcaactcttgtgtcccagtaagacaagccacaaatacctttggccccattatcaggcctccattgccataaaatctttttaactctcaagaggttacagagaatgaattactccttaatcatacttgaagcaaaccttctgtctaaaaatccaacgtagccaggcatagtgactggagcctgtgatcccagacacttaggaggctgaggtgaaagaattgcttgagaccaggagtttgacaccagcctgagcaacatagtgactcccatctctaaataaataaatagacagatagataagtaaatacatagacaaattgatagaatgatagatagataagtgagtaataaatagattaggtagagatagatagccagctaggtaactagccaaccagctgtctcaaaaaaaaaaatggctggctgtggtggtttatgtctctaatcccagcactttgggaggctgaggcaagaggctctcttgagtccaggagttcaagacgtttgggcagcatagtgacaccctgtctctaaaaaaaattaaaaattagctgtgtgtggtggtgtgcacctgtagttccagctaccctggaggctgaggtaggagatcaaggctgcagtgagccatgactgtaccactgcactgcagcctggacgacagagcaagatcctgtgtcaagaaaaaaaaaaaaagaaacggttttttccctctactttctcacagttaatacaatactcagcacaaaacacttttgacatcagattctccagtgaacaccaactgggtgtcttatgatttaattcaattctgacactatctacctggagatagtgtcagatcctatgggttaacggctcagtcccatgagattgtggcccccatttcagatgccagtcacaagcactagattgtcacttatacttctgactccctgggtataaattgcagggtcctacaaccccctcctcaggttcaattaatttgttagagtggctcacaagactcagaaacacttacttacatttactagtttattataaaggatacagaataacagcaaaatggaaaagatgcatagggcaagctatcaggaggagggtgcagagcttctatactctctctaggtgtataaccttccaggcacctctgtgtgttcagcaatctggaagctcatcaaatctcattgttcaagagtttttatagttctggtgttctatggcacagtagggtgactatagtaaacaacaaggtgttgtagatctcaaaatagctagaagagaggatttatatgttcctatcacaaagaaataatacatgtttgaggtgttggatatgctaattactctgatcatttgatcattacacaatgtatacatgtatcaaaacaaaatcacattaggctgcgtgcagtggctcatacctgtagtcctgacactttgtgagaccaaggcaggaggatcgcttgaggccaggagtttgagacaagcctaggcatcatagtgataccccatctctacaaaaaaattttaaaaattagttgggcatggtggtgtgtacctgtagtcctaactacttagaaggctggggcaggagaatcccttgagctcaggagtccaaggctgctgtgagttataatcaagcgactatactccagtgagggcaacagagtggagaccctatctcccaaacacacacacacacacacacacacacacacacacacacacacaccacattataccccataaatgtgtacaaaatcatgtcaatgaaaaatacttcatttttatgttttattattaatatttttagagacagggtatcactctgtgacccaggcttcagtgcagtgacctgatcatagttcactgcagctgtgaactcctggggtcaagcaatcctcccacctcagcctcctgagtagctaggactacgggtatgcaccatcatgcatggataattaaaaaaaattttttttgtagagatggggtcttgctaggttgaccaggctgaacttgaaatcctgccctcaagcaatacttctaccttagcctcccaaagtgctggaattacaggcatgagccactatgcctagaaaaaaaatttattaaaaagagtttttatagaactcatcccttagccctgttttcccgcctttcctggatgttggtgggtgaggctgaaagttccaacttgccaatcctctaatcctctattacctgttttttcaggtgactggccctatcctgggctacctgggagtcacactctgagttatatcattagcataaactcagatgtaatccaaagggacacattataaataagaagataatactatttctcaggaaatttcaagggttttaggagctctgtgacgggaaccagggacaaagacctaatatatttcttataatatcataggactatttccctcaatatgactttaaaaaggttcagtttttatgatgctcagcttcccccatgaccagggtgacactatttgtagtaaagagggacagaacagctgacagctgatagtcagttgtcaggacactaatatttctttattctgttaccaagcatagcattaacagaaaggacacagtgcaattcattagctaggtttgcatccaagacttggacgaaaatgaaagagtattaaaagcgggtagaaactttgaaaggaaaataaatctcggaacccccaaatcactaagccaaagggaaaaatcaagctggaaactgtatcggacaaacctgcctctcattctattcctaaataagatagttacaaagatttgtttaaaagctacatacccctgtcacaatttgcccataaggaaaatcctcatggacaaaggacagacagaactcaaagtcatccctctgctgctgtgcaacaaatgcatatctgattgcttcctttgccctattgtttcactaagccagactaaggcataagtgactattcccgtaaattgtgtattcagtgaaaggctaatcagaaactcaaaagaatgcaaccatttgtctcttatttacctatgacctggatgccccctccctgcttcgagttgtcccacctttctggaccaaaccaatgtatatcttacatatattaatcgatgtctcatatctccctaaaacgtataaaaccaagctgtatcccaaccactttgaccacatgttgtcaggacataccgaggctgtgtcacaggcgcatccttaaccttggtggaaggaacatggctgcactgaagccaggcagacataggctgaggtaaacatcctgcatgactcaacaagtttggtgtacaggcacataaatccacgtgttatataatcacagacatgtagccataacatgggaaggctcatcactcagctcagagccactattgtctgtaaaaggtacaactaccctgttaatgctgtacaggtgtgcccagagaaagagagagccagagctgtctgtcttgcagatggacagcgggaagccaggacacagtttggcttgcttgcacccagagggaaagagttaagctgctgaccctgaagggagagctggccgtgtggctgcgcgtgggagcaggtacagcagttagccaagacagagacagacagtgtaagagagctgctgaataaaaccatctttcacctgcctacaacccaccccctcccctgccctgagtgttctttcagctatctgccacccatccacccactcccttctgacctcagcataggctggaacctgaccctggacctgacacttggcaaaataaattttctaaattgattgagactcatctcagatactttttggtttacaaattggtgaccacagagggactcagtggaggtggccctgacctttggcaaatctcctgttggtgcttggtaccagcttcaggtatctttatagctcaaaccaacaggaccatttcctgaggcctgggagctcccctcccttcagagaatccctgatctcccaaaatttggttgagatctaaagtatattttgctgtacaactccttttctggagttttacttgcttccaacaaggcaggcaagttttcctgcttccatgacgatggaaggcaggtaactcctttctggagtttgagcttgcttccaacaaggaaggcaagtttgagtttcttcccgcttctaggatggtagagagcagtcttcagtctgagacccatttctaggtaaataactgaattgggtttttttttgtgtgtcttggaaattctccttaataactaaaggttaaaattgacaaccagctggtcttaatttctccttaccattagaacactcagcgatcatattgttggggttttttgttattgtttcagtcgttctcccatcggatttgaccaactctacccaatttggtcaaatctgaatgagaattccaaatcatggggaaaaaggcctctgaattggctaaaattccttgcagctgaaaacaaaacaaaaacatatgtttagtttctgtgtctgcttcctgtcttttctttcaccctattcctccttcccctttgccattgctgaccaagaaaaaaatctagagaaggcttctaatgagtcaaacccctcaaagaactcaaaatgaaggcactattcatgcctctttggagtgttctgttttctttgtggagtttcaagagtcatgggcagattctttgtaggtctaaagctctgctctcctgtattgccttacctgacctctttggtttttggcagtactagagattacctcgtactgtaagaggatttgactttggcatgtgtaatggcaaatgagagctacaaagttaagagtgggtgaggacagtttacaggaagtggtctcagctgagtatttttcctcctaggaaattgtttaggatcataattctagttcagaggttcattctaaagggtcttctttgttgcctttcctcctgaaattaatctcaattggcttgtctgcacatttgcatgaggaactgaactgttttcatagacaaatgagagactgagtttcctcagctccgaaatgaaagggcattttgctcctcccagctgaaaggcacccctgggtgatgagtgggagctttcttttctacctgctttaagtctgctgttacttttctactgaaataaaattcactgtttgcatccaaccatttctttttgttattgtttgcaaactggtgagtttgtattactatctcatggccagagttctgaattaaaagctataggatctttgtatgagtgtgcatatgtgtgtttatgtgtacatgcatgcattttattatgtgtttttggtcacaaggtaccaaattggcttaaagttaagtagtactcataaattaaataagcccaaatgcttttcaagttcatgtgacttaaaatatttaataagctagctttacaattattggtaaaataatattagaaatgtcttaagaattgtcagcatacatttttgtttgcatttatgaatcaagagatttcatacttatccctgccaaatattataaggtgtcaaaatttggcataatggttaaactataaacccagcccaaaacagaatgatatttgcttgtgtaattcttgataaataagatgttaatactgttttaatgtaaacagctaaattttggattatttagtaagataaccatatatttaatcttaaggttcttacttaggtaaacacctgaaattcacaggctataaaacgcttcacagggaaataattttaaatgatgactatcacagttttcataaataatctaggtaaacaattaaattaggtaaatataatgggatatttatagacaaatttgtcataatttagaatctaaagttatattaaactagatatttcattaaatgggtattttccaataaaaaatatatataatatagtaggaaaacattctttctaaaaaaaggaagtgtgctcttatttaaatgtgaactacttttgtctaactaaaagcttatttaaaggttatgtgtaaaacaaggtaaaagaaactaggaaataagagagatgtaaggaaagctatagaaataaagaggtatttttggttaaaaaaaagcttaaagaaaaataattttatataagaatattaggccaggtacagtagctcatgcctgtaatcccagcactttgggaggctgaggtgggtggattgcttgagcccaggagttcaagaccagcctaggcaaaagtgcgaaatcccatctccacaaaaaaatacaaaaattaggcaggcatggtggtgcatgcctgcagtcccagctacttgggtaggctgaggcaggaggattggatcgcctgagcctgggaggtggagg[137 bp omitted]aataaaatgactggttgtttaagaaagagagatgttcaggacaaaccagaaagtccaagcgtgtcatgaatggtatgtataagtcataagatttatggaaaaaaacttttatatgatctaattggctataattaaagggaaatgatttataatggtctttctagagattgggttttgatattaaaaaaagacatatactaaagaattggtttgaacaatgaaattttcttaaggtattgctttactcttaaaattacaagacattttaattctttaatacaaagttcaactttgtgtctcactgttttcagctttctctccccttttaaaaggcctgaaataataactctatcattcaactcattttcagctcctgtaagtttttttttcccttcaggttctaatttttgtagcctgatgctaaaaatgttttattgtaaaggtctaaagaaaacgtttccttccaacataatattctgtgctcttggctctaaattgttctatgaaccagaaaatttgcatttatgacccaggaaacactctttctatgtctaactaattcaagtacccttttcattagttttgagttgcaggttatctaaatggactccccatagggaacagcagtcatactgcagatcttttcttttgcctttgggtaactggcctaataaacagattttatgctttatcaaaataattcctgtcattactaagtattggtttgcttggaaataatactgagattaaaaaaaatttaattgagggtattacatccatgaaactttctgtatgtgcttttaaagtccttgtgctattaagttacggggctttgactcctgggtctaaaaagggtctaaaaaggaccaagtcctgctaaatcttaaacactaacagccgttaaagcctcatcttcggagctggtagaagatgtcaatcaaaataaactgcatgcatgagacacaggccagaaattaaagctattcaactcctcaaggcccagggactatcatgagagaggtggatgtgtgagattataagggccgattttgaccattaatgtcaaaggcacactgatgtaagaccagcatatgggtccctgtgttagattaacaaggttttcttgaagcattcacccactccttaataaaaggttataaaggttataaaaaagacttaggaaaattatatcttatagtcaagatgattaaaattttataggtttataaaattttgaaaaacaaatttaattgggcctcatgccatctttattaggacttattgttttggaaattaagtctcctgtctcaaagaataaaagtttttaacttttttaaaaaatcgagttattactttggctaaatgaatgacttattttacaatgacctgtgatcctattttgtgatatcatgtgttttaaactctttatgtttgacaaacttttcaaaatcaaattttaacttcagacctcattaattttttgatattagtctcctgaagtccaaaagagacatctttggcttatttgatataataaaaccatacagaagtattgttaaatatgaaagtgtttaactttctttggatttatataaatgtgttattagtatgtgttccagaattatatgaaattcctgtgattctgatgtgtcttatagcatgttatcggtggtaattgtgattattatgttaaattgttgtatgccatagaagtaaccaaatttccttgtcaattgtctctttaactatgactgttctaagattttttcatccacagttattttaccttcatctttttttttttttttgagagggagtctcactctgttgcccaggctggagtgcagtggcacgatctcggctcactgcaagctccacctcccgggttcacgccattctcctgcctcagcctcctgagtagctgggactacaggcgcccaccaccacgcccggctaatttttttttttttttgtatttttagtagagacagggtt[131 bp omitted]ataatcagcataggactctgacaggtgctcttgaatgcacacttttgataactttggacattgtgacactagaatagaggaaaaacctccaaggctcccatggagagctgaaatgtttatgattatcaagcagaacaggagttaactacatagactgaactaatagaagactgaaataattatgacttttgctcaaaatgttgctcatcctttgtttttcagagccaagaaaacttttcttttgagctatttacagcttttaacacttaagtatactcctataaacaaaatttagtgcatatttctctctacctgatctctccaaaatttggaaactagttgcatgtatacttaacttatagcaacatagttagttgcataagtgcaataagaatctgttttcttttgtaacaggatacaaatggaaaaaactggttattttaccaaggtattgacaggaataacatactttcagatatagtctcctttaagaaatcaaagttgacttacagggccaaaaaaagccccttgtaaaagctatcctcataccttatctacacagtccctgtacagtctcctaacacgtggtaagtaaagaatgccactttctgacaggcccaggagacccaagttttctggggaccttgaggtgaggaattcacccaattaatacaagtatttgcaggcacaggctgggcttaaggcattaaagttgaatctgagattccttatagaataaagttccagcaaagccaattttaaaaaaagagaagactatatggcaaataattatttttgctgactttatgcaaatactgcagccataagactaaaacttattttgccaatgaatttgtcctatgatttgtctttagtgaaaacgggactggagagagaaaaaaatatgtttccaaataaactatagcatacctgttagattctagtttgcctagtgtttttcaatttttattattttctatagtttagactgaattctaattttttcctggctacaagtctccaaaataatgttttcaaattgtccttctttcctttcccttcttccccatttttcctcatttaaaatcactaaaaattaagctgtgctttcttcaagccctgcaaactgaagctagacaacttcagaagaaaataacagcaacctatttacatacatcaaccactttcataactgcctactcatgcatggacttcagagtaatatggcctatatagattttccaggattgttcttgtttgttgttgcctttctcccttcctccccgttttctcttcataggacatgaaacttcacaacctgctaaacatgagctttcctaataacatgggacctaatcatgtaggaataaagcatcctagccatgagagatcagacaaacctaagaccaaaggactcattttcttctaaaatgctttctctgaaggatttttaaaaggggggaaatgtaaaaaaaaaaaaaaaaaaaaaatctcgcgaccccaaaatcactaagccaaagggaaaagtcaagctgggaaaagtcaagctgggcaggacaaacctgcctcctgttctattcctaaataagataactacaaagattttttacaaagctatatacctccctcacaatttgctcacaaggaaattccttgtgaacagacagaatttaaagtcatccctctcctcacgtgagacaaatgcctatctgattgctttctttgccctattgtttgactaagccagactaagggataagtgaatattcctgtaaatcgtgtattcagtgaaagactaatcagaaactcaaaagaatgcaaccatttgtctctacctatgacctggaggccccctccccacttcgagttgtcccgccttttcggaccaaaccaatgtgtatcttacatatattgatcggtctcatgtctccctaaaaggtataaaaccaagctgtgccccaaccaccttgggcacatgtcgtgaggacctcctgaggctgcgtcacaggtgcatacttaaccttggcaagataaattttctaaattgattgagacctgtctcagatactttttggtttacaaaacaaagccagaggcctagtccagagcttggcaaatagtccacgctcactaagggtgagctgaagggaaggcttgcagtgttaactttcctaagatattttagtaataacataatagtctctcccactgtggtttaaaatttcaatagcacatagatttgcatgttatatttttctattaagatatgaactattaaatatactgaaccaattctccttctccccctgaaggtttggtttaagattaggaagatcaagtagagaagatatcagaaggctttagattttagatatatgtcacccattgccatcgatctgtcatcataatcttggatgggctctataatgccatccttgttctggagcccagttggagttgggttcttgtagtgccactgcagcctagaatatccaggcttcccatgctgtccttgcctcctctgtctatgccttgctttgccctgactttgtttggcctggtataggcccctgtcatcagcattcatttgtagtctccattttcttaggtctgttttttacaaatttttccaaaatgtttttctgccagattcaaattctgcatggcacatcctcaagtgcagttcaccaaatgtctgttaaatgaactaaataaacaaaaaagtcagtgcaccattttttataaggcacattttttatttaaaaaaagttgtgaattccttgtaaacattggttcccaggacccctgcagataccaaaatccatgcatactcaagccccacacttgaacctgcagaatccaagtatacaaaaagttggccttacctatctgcaggttttgcatcccacgaatactgtatttttgatctgcatttggttgcaggtgtgaaacctgtggatatggggggccaattctatttattgaaaaaaaatccacatataagtggacatatgcagctctaacctgtgttgttcaagggtcaactgtatatctgttttgtgtgccaaataaggtatggataagaatttcaaaggaaaagtcatttaaacagaattacaaggaagcctcattttatgagctgacattcctcaatcaccaatacgccctgtacggctcacatacatacatatgcaaaatgggggtggggaaagtccctagtaaaagaacagtgtgtttcaagacagggcccatctccatttatgctgaagagcttagacacaaccctgtagtctaaaggaatcttccgaagaagctactcatagggctttatgggaaggtggcagccaaacatctatctagtatattgcaaattctgttcactatcctccctttctgtggaggacatagggaaataggaatcattctggcccaaagttcctctgcatcaaatgaaacacaagaggagactctaccaaagccagaatgaggcagttctccctttgctcacccatccccagcccagaaggcatattgttgcatattccccagctcagaagctgacaatcatgcattcaaatgtattttgtctcattcaacctccttgaaaggaccctggttcctgatgataaaaacacaaaaagggaaccttttgtttagtgctgctagaagcaagagggaggaggtagttccctgattaatattctagattaattgatcatcaaaaagaagcagtcagaccttggctttctttatgctgtcttcctcatgtgaaactgctaggctagaaaacaacaaaaatttaaaaatggagtgtgatgagagttgaggagttattgttaatttttttaggcatgataatggtattgtagttatgtttttagaaaaagaacgtgtatctgatatggtttggctctgtccccacccaaatctcatcttgtattataatccccacatgtggagggaggggtctggtgggaggtaattggatggatgggtttcccccatgctgttgtcatgatactgagtgagttttcatgagaactggttatctgtaaagtgtctggtgcttcccccttctcactctctcttctgctcccatgtcagatgtgccttgcttcccctttggcttccgccatgattgtaaatttcctgaggcctcccaagccatacagaactatgaatcaatacctcttttctttataaattactcagtctcaagtatgtctttatggtgtgtgaaaacagactaataaagaaaacagtcttttagagaaacatgctgaattgtttataaatgacattatacctgggattggtttcaaattaattagggggcaatggcaatttcccacaagttgttaattgttcaagctgggtgctacgtgcctgagggatcattataccattctatgtatgtttatacacatttgaccttttccataataaaaattaaaggaaaaaatctggccatctgcatttcttttcctttttcttagctgtctttgctctcatttttgtgtcttcatctgcaaattaaaacacattataatttttaaaaagttacctctaaaacctcaatacttttgagtaaataaatatgcttttgctgtttctcatttgttgttacagagaaatttattcattcaaacatttattactatttgtcaagaactgtgctaggcactggggatatatatattattaaagtcacattaggtattatatgatataagaaattaatgttaattttttcataagttaatggtattatggttaagtaggaaaatatcattttaaagagatacacagaaatattttgtagtgaaatgtgatgacatttgtaatttactttgaataccttagtgaaaaatccatatttgaagcaaacatgtcaaaatgctaacaaatgttaaacctgagtactaaggtatatagtattaattatactattccctttacttttccgaacatttgaagatttccatgataaaaagggaaagaaaactatgtgtgtgttggagtggggaaggagaatgctttctaggagctcagtctaatggaggagacaaataggtaaagagattgatacaatccagagtgacataaggaagcttgaggtgctctggacacacagaggagtctcaaaatcagaactgatttgaggaggggggttgaggaatggttgaccaagaaaggtggctctgagagtagttatttgattacaaaatccattgttgcaatgagtaagccaagcttgttggaagaagagactggtattgtaggcagagggcctctctaccaagcaatagagtcaagagaaagaacatggaatactgaggagacagaaagcagttctagcctaggcaacacagcatgacctcatctctacaattttttttttttttaatagctgggcatggttgcgcgtgcctgtggtcacagctactcggaaggctgaggcaggagaatcactggaaccctggaggtggaggttgcagtgagcagagatcgagccactgcccttcagcctgggtgacagagggaggccctgaaaaaaaaaagaaagaaaaggaaaaagaaagaaagaagaaggcaggcaggcaggcaggcacgaaagaaaagaaaagaaagagaagagaagagaagaaagaaagaaggaaagaaagaaaggaagaaagaaaaaaagttttcaggccacagagtatggtgcaacaaaaagtgacagggtatatgtgattagagaaggatcagtcagggtctgaactttaccctgagggctatggagaactactgaaggattttgagtatggcactgacatgcttagatgtgtgctttaagaaagtttggttttccagtggcaaggaagtaaagtgacattggggaccaggaaactggggcaatatcagaggaagcagagcctttgtggaatatgccaaccaagagaaagcaccctctggtcaatcattagacaggagagggcgtaaaaaaggtggctttttgtgatgcactaccccagatggggtgccttccataaattggcagccagtctaaagggagtgcctttttgaaaactgtacagcagtgcccactgggcacgagaattacacaaatgagcccttccactgggctgatgcagccctgtaaggcttactttggtacagcccaatcccctgacttggtctggtgccatgtgctttgtacaactatgcacaaccaatctggagtcagattgcttaggtttgaatcccaactgtatgaccttggggacagtacttataatctgctctgtctccatttcctcatctataagatgtacccaacagttatttatggattagatggtaataatgaatataaagcacttatggggaatgcctggcacaaggttagcaagcgttcaaaaactcttcagtattattagtgttttcaggaaccttcttctaaaataagttttaagaaataaaactagttttgaagcaaggcttgcagaatgctgttggctttcttaccactggagtctgtttcagaatcagagtcactgtcgctatcttcagaatacttcttgtgttttctttttgataaatttttctttcttcctttcttggacctttcacttgaatgactagactactatttttctgtaaaaatataaataaaaaagtaacttctaaaaaagtatttctgattatcaattttattgcatttgaaatactgaaaaggaatagatgataggcaatttgaataaaagtaaagtctaatgtttaactatttataaactttttctaacttctcaagaaaggtctgtatcttaaaaatactttctgatgtagaaactgaagtagtgcatttctttggctcttcattctttacttcaatatgttcagcagagctgaatttaaagaaaatggttataagaattagaaaagtgatgaaatatggaccatagagtataaaaacacagacttaaaacttttcagcaacaatgacaattgtccaagaaccattaaaaacaagcattggacttctttcataagaatacagttcatgtctgtaatcccggcactttgggaagccaaggtgggaggatcacttgagccccagagttcaagaccagcctaggcaaaatagcaagaccccatctatacaaaaaatttaaaacattagccaggtatggtggtgctttcttgtagtcccagttactcaggaggctgagatgggaggatcacttgagcctgggatgtcaaggctgcagtgagccatgatcatgccattgcactccagcctgggtgacagagcaagactgcctaaaaataaaataaaataaaaaataaataaatacagttcaagggtctgccaccttcataataataaaataacttacatttgcacaatgctttacagattacaaagcactactcaaactgaaagcagcatggaggatttatattttcagaagaaatcacaggctaaaaatagagaaaacagaatcagaaggaaagatgaaagaaactgtatataaaaagtctgaagaagatatcataattttattctaagcatgtaaaaaacaaatggtagagcagcaactgttctgtctcctcagagcaagaagatcctaagaagctacaatctaaagagatttgggggacacatgttctcaggacctgaggctatgtcacggtaaaaaattgtgtgtgtgtgtgtgtgtgtgtgtgtgtgtgtgtgtgtgtgtatttgttttgttgcagagaattcttaaaataagtattattaaagttctacagtaggcttggcgtggtggctcatacttataatctcagcactttgggaggccaaagcacaagaacagcttgagcccaggaattcaagaccagcctgggcaacatagtgagacccttctgcacaaaaaatttaaaaattagctgggtgtagtggtgtgcacctgtattcccagctactcgagaggctggggcaggaggatcacttgagctgggaaggtcaaggctgcagtgagccatgatcgtgccactgcactctagcctgggtgacagagtgagaccccgcatcagaaagaaagagaaagaaagcaaataaatcaataaataaagttctacaatactttagaaagggactttctatattatataatctttccctttgaagatcacatctgcaataatttaggtattgcctagaaaattatttttagggttccttctgactctaattctatgagttcaggtcctttaagcatttaccaagggtatctataagaatacacttcagataataatgttttatcaccttgtcacaaattacaggtttacctgtgaaacacattgcctcaactcaacctaaacacagaaatagaggagagggaagaagaaacttatgagcaacaccaaagagaaaagaaataagcaaaaaaaaaaaagtactaatatttcacatagtattggatacaggaaaattaactaaaccgaactacactggcatctgcattttttaaaaatcgctgtgtaatactattgtctggaatgcaatctgctcctgggttgaagaaaaaaatcaaaatataaatgtattatctgttttaacactgaactcctctattaataggaaattagcaccccatgaatacaatttaaagaaaacaattagcatgctaaaatgcactagcaacatgttttaattcttaggtatgttagactccctttagttcctttttaaaaaagagtaccttacctatctgttctttggaggacactaattttttattgtattataatgtttgtcatttattgttttaatttttgctgttactcataagctgaaaaaaataaactaagagaggttcaatttcctcaaagtttagctgcttacgtctataaaaatccttataaaataaatgtttgatttcattgtttgaataaatattttttacttctttattcagggaaaaggtattataagtatacagagttagtctcagagggtttcccatttcaagagcaggtaatcaaaaagtaaacatacgtctaacagttcttggaatatgagtatagggaccaaggatgcctgccagactataaagacacacagtctttgtggtgtgaggcacaaaattaaggcccaatattgtgtactaccttgacaattggggaaaccaggagggctcccaatggccttactgcgaattctcctctccattctgctcctgcaaataaggtcccctagccaaatgaccctccttctcaaagagaccagacgcagttccagcttatctctgggtagcagattttagtacattgtcagcttgtggaattattcaaacaagccaatcatatccttccaagggaaagcaggtattacctcaatttcttgataccacaaagtctacctcccacagcccctgattattcactgtcttaccaacagcaacctcggtgtggcccttcgtggcacgctgtgttctctcccattccagctgtgaacatatgtgattaataaactgctgttgatctcatctgtcctgtgttcagctactccataacacaaagggtgggaatccttccctcatcaacatggtgaatagcagacaattataacactccctgctgctacctggttttatctgtgccttaagataaattatttatcttctatgtgcacaaatgcaaattttacccaagttgttcttatatgttttggttaggattctaaaataagaagttttttgattgacacaaactgggaggacctttccatcccaaaggcaggagcgctcctcagaggacaggtgcagtagtttcactcacctctcccacatgggcaaaaaatgtgtatctgtaacctaactcaggactgtttttacttcctctgctcccaggcatgaaactctaataaccaacacctgtgaaatgcttattacgttcaaggcactacatcattacaataaccctaaaaacgtcagtactatttgtatcccccttttacaggtgaaaaaataatgaagcttggagaggttaccaaggtcacataggtattaagtagcaaagcaaggcttcaaactcagaaagtctcaatccagaggctgtccttctcatcactatgctttattacatcccactagtggaagaaaaagactcatcaagacatctcccacctgttggaatttcaacctacccctcaatacctgtaatgttttaaaatttctcattttttaaccgtagtgcatgtaaggcactcagtatagtacctgacacattcaataaacatttgatatgagtacttacacagcaataattataattattttccttctcaaaccatctacttcccactccaatattcactctcattagaggaaaactcatctcactctcctctcattcttcaaggtcaagattgagaccacttaagaccttcctgaaggtagccacatctgcagtttagcacatcactttgcctacattcatccagttatcttgtctcagaggaaggtatttctcctttccaatttaaacccttaatctcaaccctttccaactccctacaaggaatttccacttagttagcctgttaggatctcaaaccgatcattcactcaacacacaacactttcagtagattgagcccctattaagtgccaggcactgcaaattctgtaatgaataaaataggggtcctcctttccacgagctcagtctagtggagaataaaaatatgttcacgaacgataacacaaaacaaataaatgctatacgtaggtctgtgacccttagccgtgtctgctccgagatcagaggcgaaagagggtggagggagaccggggcaccctacaaaggggcccaaggatgagtgagaatgtgagagaggagaggggcgaacaaggagctgtcgtggatagattgcagaaaaggatgaaaatgggcgcggtgaaggtagaaggagcgaaatgcaaatggtcagaagcgggctgaaagatgaagcggactcgctgaaggcaagtgggctccttagagcgaaggtgcagccatgatctcactcacctctgccacggattcacctccctctcctcgtcccgtaggagcgtgagtagttgccgcaataggcgcaagagcaggcagaagcgaaagtgatggtccacggcgcagtcagccgctcttgagaatgcgaccacaactgggagcggcagggctggtttcgggagccttggctgagcccattccattccccagtcagagaacaagagttccagtgagagttgcgccccagcggggaacgggcggctttgctgggcttggggctcttggacaaactgcaacacattcccccgcccggagcccgaggcctccctctcggcactgcagaaccggacaccggagctactgcagcctcgaaaacgggacattctcaggagcctcagcagtatccgttgcctttgctccaaaaacccagcccgcgcaaccgctgggagcaaaggaaaccatgggaactattgcgagtacgttggcaaaacatttccccaggtctgtgtggcctccggccaaggtgaagaggtgtgtgtcttggtgtaaataaaccgctactgcaaccgatttcgctcatcctttggttccgcattgaggctcgccagggtctaaatccgcacagagactaggtcttccttaggcttctacttgaaataactgaagggcaggacgagagtccactggagacatttcacagaatggccatatcaacaacatagacaattctgttcgtgtacgggtgctttccgtgaatgtgtgtattacatgttctataatattgggcgcactctgtgtcgtgtgtgtgtgtataaaatatgtacatttggttatgtgtgtatatatgtacatatataataaataggactggctcaaacagattcacatattttttcggagtctatttgaattaaaagaaaaatctgagatgggaagaaaagggacaaagtattcaaagtatttcgtacacaactgaaagtgtttatttcagtgttgtcagatttattaatagcaaaaagaaatatacagtaggccacttatctttgaatttcaaataaagaataatgttttagtataagtatgttccatacaataatacagtagaaagtgactactttctattaaagatgaggtgatagccacggttgtacttcttcctctcctactacttctaaaatttgtttcttatattctttttttgtttgcttgttttgttttgttttgagatggagtctcactctgtcacccaggctggaatgcaatggcgcgatctcagctcactgcaacctccacctcctgggttcaagtgattctcctgcctcagcctcccaagtagctgggattataggtgcccgccaccacactcggctaatttgtgtatttttagtagagacggggtttgg[132 bp omitted]gctgtttgagaaagggaagtgggagcagcccctgatatccacaaactgacctcgcactcacaattaggcatgttcttctcttgttgaacataaactcacagaacaccaacccaagacaagatcactgggagcctgatcaagtgagacaaaacaagaccacttcataagcttgtctaagcacagacaaaaacaagctcactgtgacacccagaaaacaccaaacaccccttcttggccaagataggtcactgctactttgccagttaatgtacagctttatcctccctctagtctgccctccctataaataagatttattgaaatgtgcaatcatacaattgcccctgctttctgatgtatctgagacggaactcctgattcctagaccttcccccaaattgtccaaatcctataataggttcattctaacaacttcttattgaaacacatcatagttacctatagtgtgtgttgtccctccctggagtaagagtaataaactcaatctgtcaactatgggtatgtttctggtagtctttggttgaagggcaatgacacattccactgcctaaaatgttcttccccagatatttatatggccctttcccttagttcattccattctttggccatacatcatcttttcagagaggctgtgcttgaccacacaatttacaataacaccctcatcattctctatccctttgctctatttttcttcatagcacttactactttctgtttttgtattatatatttatattatatatatacaaatgttgattgtatgtctcttccattataatgtaagttccatgaagaccaatatctcaacttgatgataattatatccacagtgcctacaacactgcctacaacactgcctggcacagagtaaatactaaatgatatatgtttaatatgtattgaaaaaatgaatgaagtttacagtgtcgggctttataagtttcattgtcacatagtcataatcaatctgttgtttggacttagtcttccacttaaatagattggcttactgcaaaatctccattcttaattctttatttggactcatttcttatttgatttgacttcatatattgccaagtaattttcacaaatgactcataggtagtatattccctcaattttgttcaagtttggaataagctgtctgttgctttttttggtagattgtattattgttagcaattatcgacgactccttttccagtaggagagttatatatccctatccaattgactttggaaagttttaagaaaaaagggcaataggcagtattagacaggtcacttaaagagagatttgttgggattaagcagaaaaggggatagtggtgagaaagcaacatatatttggcacttactgggttccagacactcattcgttcagcattaagcaaccatctctatctacaatttgttgggccaagggatgcttcacaaataagttagtacttgagttgggtttttatggaaaaccaggcacttgccaggaactaaccagacaacaggttaagcgaggtgtggctatgaagggaatgactattccaagctcagggctccaggctcagacttgaaggcagtaaattgcatggcatattctggaaaccgtgagcagtttgacactatgcatagttgattcatttaatcctcaaagtgactctgtgggaaggtattattatccctattttacagatgaagaatcaggcataagatcaaagagctaggaagtggcagtatcagaattccaacccactcacatcttctgcttaagactttgtttcttccactctaccttactagggtttctgcagatcccatggagtgaccttaccaaatctgtaaccataagcataacatataggaagtgctctaagactgaacgagtgtcactttatcttttgtcatcaattaatatatattaagcacccacaagattgttggcattttaacacaggagaggacagttaccgccctcatggaattcacaatcaaggtcaaaaggcaagcaaacgctgacaatacggctataaaacctaactcatcccattttcagccaataaaacctttctagaatgtgaaacaattgatacctccaaatccatttgatataggttgttctctgacctcaggtgatcctcccacctcggcctcccaaagtgagttgttgttgtttgaaatagagttcaaactactgggttgtttgaagtagggttaagccctccagattaaaaacaaaagtaaaagtgaaatgactagttgagaaacagaaaattaattaaactttccagtgatcctgtcccaaagacaattattaaggccactcaggcttcttggtctgttctgctttcctacaaataaaattcctttcctgaccattggaccccctttcattataggtagcttttaaacttgtttagtttttgcttggttagggggtgagagatacagcaagaagggaagagaaggtttactgtgctttgaatgaacaggtttcatcatatgttagttggtactccaaacttttaaaatactttcaggaaagtgacaatggcatggcaattctgttgccagcctcagtgatgtaaatgctggtacaaaataaattgcattgtgccttccagtttactgagagctgaccaacaaacatgatatctagagtggcatctattgccactgtgatctgtatttcaaagatatgtctcattttagttttcatcaattaagccactgaaagataaatagatcctaaactttcaagatatactttgttctaattactaagatttttttttttactactaagttttggggaggataactcagaaaaatggttattaagtactcagttgccaggaaaaatactaatctgccttagtttattttacaacagcatacttctatttgccatgaaatatctttatagtaaacaatgaaacttttcataatgctaagtcctaatcaaaaatcaataatgcaataattcccacatagtttgttttcccacaatacaaaatcttggagaagagcttaaggaattgcatatttccatgtgaaatacagctatattataccactttgatgttttattataccatgtggctttactttattgaggaggatgaagaatagattagggataggtagatgagatgatgacatccatgtctgatttcctgtcagagaaaattagatatagttacatctgttttcagtctaatatcctgatggacattttcagcaagattttttaggaaagaagcacaggaattccactgcaaggtattaataggtacaaatttaagattttggaaatgaatgcagtattatcctatatatatctttttaaaaagataatgaaggtagtgaatggccttaattatggcagaaaaaaagttactatttggttccttagttgaatacgatcaataaccagcctaaaagggaaacattttgctctccaaacacccatcctgttgcttcatttattatggtactcagttggaagggtattaccagaggattttaaaaaattatgtaactcacaatgtattttttcggtcattaaacaatcactgaacacatactatgtgtcagacactaaagccctctgaagatgaaatgttatggaaatagtaataataaaaaattaaaatagtaacaataaaaaattaaaaatgcaagtgttaatattattaatctttcaagatacaggtcaaatgacagcattcaatttgctattctcttctctctgcttctacaccttgtacaaatatttttgtccatgtttgtgtacctacctactgagctccctaaagaggtagagacctttgggttattcatttttgtattcccgagagcctaacatagggtttttgctacagatcaagcagggggtcagtaaatgctagttggaatgagggaattaacatagtactgcaccatttagtattcaattaagaagatagttgtccaaacactaaatttctttcttaaaagtagttactgtaatgtagttgctctcttgttatcccagaacttgaattaccataagaagttgtgaatttctatttgattgtatgtattttgattatatttcaagatggtttatcatctagcaaacagtctaatagagcagattcaaacttgcaaaataaatgaaacctgtatagtctctaaaagtttgtatgccctagaagttcacattgaatttcgatgaaaacgactcgcttcccttccatccaattgcttgcgactgtcttacccgatctttccctttccttttttcccacccgttagccctccggaaagagccgaacacacaagagcttcccagtcttcctccgcccccttgcggaaagaaccgaaggcagagcacggcgccgaagtggagccgcctcaagctcgggcccttccggaccaccccggcctgcgctcggaagaggagggcgcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggtgaggacccggccccaatcagggagggggcgaaggagcgcgcttgccttctccgtccctgggccgcgcctgcgtttgcattcgcctcacttgaaccaggaagcggcagagtcggaggctcagctcctccggctctttctttgtgtgggccggggagcgaaggaggggacgagccgcgagggccgcggcgcggtccccttcgccgttaggggccgaggggctgccggtgccctgggtaggccccggggcttggggaatccatcacagagacccacttggcttttccctcgcccctctcgctgcttttttgtgcctcttttactcccctagcccctactttgatttagagcttttctgccaggcccatcctccccttccgtccccttcccggggcacaacaatgccgcctgcttcgcttcatcccccccccaacaccccaccctgccgttcgccaccttctactttccctggtaccccatattcctcccgccctcactctgctgtttgtacctccgtctgtatttgcaagaagcttgctttgcacgtgaattggggttaaaaacctcggttgcagctggcagggtccatatggggaagagggaggtggaggaagggagatgaggttcagctgccgcagggagccgcgtgtcggtttgtttcactccctcgcggatggcttttatctctttccaccgtcaccagctcctccgaactggccctcggtcaagggtttcacagtgatgtggaatggcttttccacagtcgaatcgcatatcttcggagtgggttcagaccgacttgtgctgtctctggggccaccctgagtgggaggagggggacacataaacgaaacgaaaccgagtcccagtgtcacctggacacgtacatttgacgcattcccatattggaagaacccgggagcaaatgacaaaaattgcgtgccgttttcagaaaacctgtctttccacttaatatcgacttctgtcgaaatgcccgtatttcggaagccctggtttttggcaaactgtccaaaggtcaccctttctgatgatgaatgcctttatggtaacctggaattccttggtactgttaacatgcaacaccttctaataatgttttaaatcttgatttttagactttttgcctgctgtttgttcttaaggtatcattttgaaaaatttagaaggtatttgagacagaactgccctccacctgtatataacttaagcattgtgacatcgacacccttttggtaacttcaaagggagagaatattaataaaaatatttcttcactaaaagtacttgtcaactaattgttaatatataatatccatatattaaaatatatccatatataatatgtatggatattatatatttttaatatatgggtttttttaaactctggcctctttgttactggaaatatcttctgcaaagtgcaaaaaatgatgttttgctagtgctacacaacaatgcattctactgacatcatcccctttttctagagtagtctattccaataagttaatgttttcattttcactaactcatttggtgtggaaaaaattctcataccaatgcatatgattctttaccaacaaaaataaaatgtttcgtgttttcttggaagtgggcatttagaaatggtaaactttccttttcctttgtcatattttttcatgatagtgtctgttgacttcacttggcactgtttaacattccacctctggaaattgtaaagatggagagatgaggggaagggacaaggggatgaagaaagaggaaagggtaagaaagatgtttaatagtttatcaagatgaggcaccccaatttaaataacagaaaaataatgggacgttgggaggtaataattgtcagtgtttataaatgtcattggctccagggtgtagattctgcatatattcttaaagattagttaaaattaagagtatgtatttcagacacagtattgcacgcgctgagcttttctgacatttcaatcatttacaggcgaaataacttctgtgtgttcatgatgattttccttaattttgacagttaaaagtcaactcttacctcttcttggagagaaaacccaaaattgggactaagaaaattaattctaatctttaaaaatcacttagtggaggtgcatgtatctaatattcaaaaaaaggtgactatggagattactgttcaaatctctgtaacaatgtaaaacttgctcaactcaggagcaagccatgaaattggacacttgttccaaaagccaacctgtatgaacaatttctgtaaaagccaaaaaattatgctgaactttggttaaaacttgaataaactatttaatgatgctactgcttaaattctaaataagtacttttgttttttctctctaatcctctcccatcccctcctctctttctcttaaaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 966 - DNA, 7588 bp, mus musculus
tgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggtgaggacccggccccaatcagggagggggcgaaggagcgcgcttgccttctccgtccctgggccgcgcctgcgtttgcattcgcctcacttgaaccaggaagcggcagagtcggaggctcagctcctccggctctttctttgtgtgggccggggagcgaaggaggggacgagccgcgagggccgcggcgcggtccccttcgccgttaggggccgaggggctgccggtgccctgggtaggccccggggcttggggaatccatcacagagacccacttggcttttccctcgcccctctcgctgcttttttgtgcctcttttactcccctagcccctactttgatttagagcttttctgccaggcccatcctccccttccgtccccttcccggggcacaacaatgccgcctgcttcgcttcatcccccccccaacaccccaccctgccgttcgccaccttctactttccctggtaccccatattcctcccgccctcactctgctgtttgtacctccgtctgtatttgcaagaagcttgctttgcacgtgaattggggttaaaaacctcggttgcagctggcagggtccatatggggaagagggaggtggaggaagggagatgaggttcagctgccgcagggagccgcgtgtcggtttgtttcactccctcgcggatggcttttatctctttccaccgtcaccagctcctccgaactggccctcggtcaagggtttcacagtgatgtggaatggcttttccacagtcgaatcgcatatcttcggagtgggttcagaccgacttgtgctgtctctggggccaccctgagtgggaggagggggacacataaacgaaacgaaaccgagtcccagtgtcacctggacacgtacatttgacgcattcccatattggaagaacccgggagcaaatgacaaaaattgcgtgccgttttcagaaaacctgtctttccacttaatatcgacttctgtcgaaatgcccgtatttcggaagccctggtttttggcaaactgtccaaaggtcaccctttctgatgatgaatgcctttatggtaacctggaattccttggtactgttaacatgcaacaccttctaataatgttttaaatcttgatttttagactttttgcctgctgtttgttcttaaggtatcattttgaaaaatttagaaggtatttgagacagaactgccctccacctgtatataacttaagcattgtgacatcgacacccttttggtaacttcaaagggagagaatattaataaaaatatttcttcactaaaagtacttgtcaactaattgttaatatataatatccatatattaaaatatatccatatataatatgtatggatattatatatttttaatatatgggtttttttaaactctggcctctttgttactggaaatatcttctgcaaagtgcaaaaaatgatgttttgctagtgctacacaacaatgcattctactgacatcatcccctttttctagagtagtctattccaataagttaatgttttcattttcactaactcatttggtgtggaaaaaattctcataccaatgcatatgattctttaccaacaaaaataaaatgtttcgtgttttcttggaagtgggcatttagaaatggtaaactttccttttcctttgtcatattttttcatgatagtgtctgttgacttcacttggcactgtttaacattccacctctggaaattgtaaagatggagagatgaggggaagggacaaggggatgaagaaagaggaaagggtaagaaagatgtttaatagtttatcaagatgaggcaccccaatttaaataacagaaaaataatgggacgttgggaggtaataattgtcagtgtttataaatgtcattggctccagggtgtagattctgcatatattcttaaagattagttaaaattaagagtatgtatttcagacacagtattgcacgcgctgagcttttctgacatttcaatcatttacaggcgaaataacttctgtgtgttcatgatgattttccttaattttgacagttaaaagtcaactcttacctcttcttggagagaaaacccaaaattgggactaagaaaattaattctaatctttaaaaatcacttagtggaggtgcatgtatctaatattcaaaaaaaggtgactatggagattactgttcaaatctctgtaacaatgtaaaacttgctcaactcaggagcaagccatgaaattggacacttgttccaaaagccaacctgtatgaacaatttctgtaaaagccaaaaaattatgctgaactttggttaaaacttgaataaactatttaatgatgctactgcttaaattctaaataagtacttttgttttttctctctaatcctctcccatcccctcctctctttctcttaaaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctga

SEQ ID NO: 967 - DNA, 237057 bp, mus musculus
cgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtttctcttggccaaaatctgagttcacaagtcttgaaagacacacaggttgaatatcaatcctcaatcccacaccccagtatcattgagaggtatccggtatctatattgttccccaattcctaactggccctagtgtgggggaacacaagccaaatctccgttccctttgcttataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtaagtagatctgcttttcctccctttgggacgttggggacctcatttgcatctttcttgtggcacttagggtctgtgtatgtgctgggagatgattgcttcagtagatattttaggggctctaatccatccggtttcatgttgcataaatcaactccaaatgatactgctgaggggcttaagacagtgggaaaaactcaagacagtgggcaaaagtctgctccaaatagtgtttgatgcaaaagtttcattttcctccatgctaacctagtgtgttccttctccaacactctctctcttttttttttaactggggaaaaaaaaagaaagaaagaaaaaaatagcacggttgttcagagaaatttcttcagatgagatttaaaaaagcagcagcagcttcttgattgagtcaattcaggatgtacatcacttgactgttaaagctagtgcctggctctaggaacgagctgaatttgacaattgcctaatgtgtaggaagcaaatatgagaaattctgcaaacaagtgaccttgaggggcagaacaggctgggttccctggcctctttctgtcctcaaatattaccttacttactgagagagctctgataggaactcataagactacaaactgattgcaagtgatgaatgcctagcaaactgaggggaggggagaaaatggtgatcaggtgatgatttagaaagctagttctgcctcccctagtgttgttcacccccatgatcattaaagacaacacagttcttaatttagagcaaagagggggcaggaggagaggaggcttggagcaggaaaactgaatatggaaagagaagaaattcatcaggcccaaagccggttctgaaatccttagttgtaccgggtgattattcctctgaaaaggggacattttgtaaaatacaaccaaaggaacctaaatggctaatagcctgttggacatatggttttacttgaatggaatgtttcgtgagaaagactgagaatacttcatgtaagcttatttcactaaaagttttcacaacaatgaggctgaatatggtataaaatatgctttgcttttatggctgatgtagtttggaatttggggtttttcttcctttctcttccaagggagaaatgatatttatgtttggatgggtgaaactttgtatatgactttctttaaatccttctgcctcaaaggatgcatggtttccagaaaccactgaaagggtctctccaagggcacaggtttcttggctttgaagacttgggccaagaggatgggggtaacatactctgcaagaaatatgacagttgtcagctttaagaaaattttagctgaagatacagatccttatatgaacgtgttctgagatactccatatttgactttctttggctttctgacattgacaaaaataggaatttattaattccagctagtgtgaaagttacgaaatgtctgtctatactttgcatcttattttggtaatcccagcctgtctccacagcatttacaacacgcatctgactcttaatcctgcagcactgtgatcttgtcaagaggctgaatctcaaatgcagcttcctaaatatcaattagaacagatttaaaactaaatacattaaactaccagggtttattaccattagtaacaaataatatttatttcaactcccttcagtgtcttttcactgatgagaactgggataagagaaccatttggtttctcagaaatgattgatttccaaggtttttggtcctgttcttatggtcaaaccagattgacacccaccagccctggactgtcagaaccccactcaagaagcaatcagaaatgattcttgccatgtgaaaatctcaggtttaggaaaaggcaataagtcatccatattggtattgagttgccttattgccttacctctcagggcaataagagaacaaccaggggaaaggaaaagaaattgatcaaaatccctcaccgtaaattcatagcatttccacttacaaggctgggttgtggctaggggcttgagagttcgggagaaggagtgtggctcactgggcaacaagaaaaagaaaatgaaaacgtgaccttgcccttagttatgtcaaatacacatgtatgcatgcacagacatacgcaggaaaaatagctagaaaccagtgttgtgtatccagctgcctgttgctttctctgaagacagaggaggaaagctgtcatcttctctggtccctgaaacagtcatctctgaatgtcacaatcattgaatgggggccagatctcaaagctgtctctaggcagctgctgcttggtagcttagtatgagaaagatgactcgtctaaccatagtcttggaatgcagaaaccaagtatttcaagggaccaaagaagccctggaggtgtttctcatttctacccctggctttaattgttctttttcttgtggaagcggagatcaaatatttccaactgggttgaaattctagttcagtgctggagcctgacaggtgacccccaggttccactcctccaaatgattgccctgattgtgcaaagagaaacctctgtatcctccggcctgtccttctctggagacctagggagaattccagaaaacaacagatgagtctcaatctggccaaccacctctcctatctggttcaatatggaatgggctggcaaaaattaaagaaactttcccttattcctatgcaaaattcctagtttcaacttcccttagcactagaattgatctcttctcatgatctttcctgcaccctcaatcctgaggcaggcacacactttctagggtgtaggtgtgcaggtaaacgaatacacaaagaataaacaaagggtaattctttcatatatgtgtccctgttctctgttctccctccacatcacccacccctacaacctctgacaatgtgtttgaaaggtttccttgcgatgaatcccaggcatcagttatttaaagactcttcttcatcagaaaccaatttttttgcacaacccccaagaggtttgcttaagacagactccaactttattccatgtcctacgaggccaataagagccacactggctttgaaaggtgtttaatttgggatctcaactcagagatggattgaagtttatctaagagacttacctgatttgaagcacatgttcccatttcatgaggattaatagagtttgctgccttacttttcaacttagctagataaccccagaaccaagagtggtgtgaattctttggcttcaggatatatacattcatagacacacaatcaatatatatgaagagagatgtatacacatgtaagttacatgtgtgttttttaaaaaacagattcaatagtcctaaggctttcagggcaggggtgtggaaacaccaagggactgatgtgtcccatcgtgtggctttgctgtcctggttcctcaggaaacatcgccgattcccttgaagtcccctcctgtgtctttctgctgtgcacttgtagtgcactccacactacaccgccccagcctctgcagtgtcagctcattagcacacagatctcatattccctctccgcactgtcattgcaaaaattgctgttgtacacctttacagccaacaaatgtgcttgtggattacgcactgtttgcaagaagcagggaaaaggcaaatgtaaccttaaaggttattcaccacggaattgtactctaaacgcattggcttaaataaaaatctgttgatggaggcacaatggtgatggtgggattgagaataggacttaggagtgcaggctttaatggagccccaggtaaaatcccttttgctggctaaacgtaacccatcagatgcaaaattttattccattaatttttttcaagccatttgaaatataactgctgagaacacactccctttacaactaagcgcatttcactaccaaatatacttagctgagacaggtttctgtctcttgcctacagagtcacaatctaattatctaattattataattgccaaaatcaatttaactatttatgtccatttgggaaggaaatgtctcctttgatcccattctttgcaatttggtgggttttgttttgtcttggtttggctttggtgtctgtcctttccatgtaagatttggaaaccaggtgaagactcctgggatcaagatcaagcctccttcccttaacagattttgccatactacccaacattgactgctctggttccactccctccctcactccccctcttccctgcctttgtgcctttgctgctctccctctctcctctgtctgctggccagccttcagtaagcacgccggcttagctcacttctcggcccctctggcttagtcccctgaagcatgaagaggttgccttagtggtgccagtcaaaaaattaagtcacgttttcacaaggtttattacggtttttaaaatttatttttcatagggcgggggagggaagaagctgatgctgttcatttgggccataaaaatagatggcaatcagcaggctgtaaaggtgagcttcctgcaaagtgtattacctcccctagaaggcagcttcctattgatctactaaatcaggggggacagcagcaagaagggtttgaaggaaaggaataaagggaattattttgttctccatctacatttactgcaaaatgggccatggtttttctccctctctgcaattttaactttttttccctaaaatgaaactagttttccacattttcctacttctgcccctacagaggtaatttccttaattctgcatttccctccctagtccctaagactgagtgataatagtggaggatcgatgagctttttgttatgtttttggctcctgatgtatttttaaatttcattgttatgggtagtcagaggtgattggctggtttcattttaacagattgaaaaataaatgaagctcctgaggcatcgttatttgtcttcctttttacagttaaagagatttgtcatttttatacagttggtttaaggattaaatgatggcatagattttaagacagggccagaattttagacgatagaattccataactttgggggagactaataaacatgcttatccagatgatttccctgtcaacttcttagattgagactgcaaaataaatttgaaggacctttcataaaaccatctatcttcaatgaaggtcaagcaaataatctgtatactttacctgctccattaaaaaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgcccaagagagcgaaggttggcatgcagttccaactgcctttccactttgcttctctgggtcaaggcatgccagaaggaggaatgtaacatctgctcctcagctgtctgacttcccttaaacagggttagaaacaagaagtacaacacaacctgaattctatctggttccctaagagactgaaaaattgactccattttcaaggcctgtgccaggcactcactgatgggagggatgggagggaagggaagtaatgtcactttctagcagacctgagccgagaactgctccagggaagccattaaaagcttacccagtgtcatttgaggatcgcaaaatagcaaaattccccagaaaaattgccccccaacagtgtgccattagtctgaaattccacaaatttgtttatttgtattactgcactgaaagcctgtgccaaaatgcaagcgtgctatctggaagggaataaattaaatccttatcagtcattaatatttcaaccagaattctctgttcagattaccacctgttaccttgcaggatcctcagagggggctttccaagacaggtaaatgacccagaacaagatacctgcccaaggaagtgaggcaccaaatggattgcgggcattcagaggggcgctggtagactcttgaggataaggaagattccctcaaatacacttcacctatttttcaacatttgaccttctccatggataaattctggtactttattcactaagattttagttatctttaactattttagctgcctttgaccgaagtcatacccttctgatggtagtgggcctgctgcctgttctgtgtgtggtgtttgctgcaataggtgatttcagcttcaggattttccacagttactgtggaaaattttcagaggtaaaatcagtttgtgatgaggtatggtgagaatttaagcttttaaaaattgttgtgatcaaaaataattccctctcaattatccatgattggctaatctaccttgccaattactcattgcaaccagggccttcatctttgtagctccccagaaaggggtcaagccacaggcaataaatgagatgggaagggatcaggatgcagctcacagaggggtaagtgtatgggtgtgggtacaggtctttgtgtaggtgaacacctttgcacaattaagattagtaaagccattaatgtccaaagtcagtcagaacctgttaaacattctcaaatatcctagtacctcactgcagtttccaaagctccttgttcattaaacagtgtttcttgaattgggccacttgctttagaatcaccagagatgcttgttaaatattaattcctgggtcataccctagatgtattgaatcagaaactatcaagataagcattttaccaaggtctatgggcgatactaacgcatactcagtttaggaatcacaggtttaaaaagccccagtactacagagatatacagattcagattgaatatttattgaatacccactgagcaccaggtattatgccaggcactttcacatatgttacttctctatgtaactgaggtgctattggcctatgcaagcattagagagtttggctttcaggctggaaatctaagacttggaagaactaagagactagcctcaagtcacagtctctgagggaaataaaacagaatgctctttgagatggtaagtagagacaaaggaattattttcattttgacaatgcttcttcctttctttgcttattagctaatgattcgtcctcagacatgctctgaactagacgtcatggcaaatgccaactcacttattaaaaataaatgtattgcaatcagttcatatagcaatcactgtgccttcctccccatccttgctatcaacaaatttaaaaccagagctaaaataataacagctaccatttattaaagccgtaccacatggaaggcactgtgctaagcattttacatgccttatctcatggaatcatcacaatattgccacaagcgaggaactctcatccccattttctaaaagaggaatgataggtggttcaaaatgcataagcaactagctcaaggtcccacaactagctaagtagtggagccaggattcgacctgagatcttcctgtctctagaggctgaatcaatttcaacttgggttgaaatttcaaatgcatataggggctacgcagaccacataaaagtggtaggtaattggaccaggtgtgttataatagggagtggtggggcctatgacaatccagagagtccatgcttctgcctgaagacattcaaattcaattttcttaaaccactatgggacaaacaaaatgcctgcaacaggacctagaaggactgggagtggaaagtacacatttctgacctctgcactatactatatacctccttttagcagctaggttactggttgagggaagctctattaactggtagttataactactgagaacagcagagagaaaagctcttctcagtaaaaactctattttgactttcttcttatagtgtgccatcaaagtatctcaatatggtagaattttttctcctttgtggaaatacttgtggtgccatgtacatacactctatatctagtagcttttcatgactgagtgccagcttgactctaactaaccttcccccaggcaatgcggaggccctcagcaaggtcagaatgctggcacaaggtcattaataagcgcccagcagatcagaagaggtacatcaccattggtggggggaggctgtgctctgggacaacttcttaggttctagaacatgcaaaccccaggcccacaactgggaggccactgggtcaagtaaggctatgtcaacagccacccagggtaggaacttcccatatactctgagaaagaggctcaccaactttagaccagggtctaaaatagagatgtaatagttgtctggagttgtaaactaacctaacccaatctggtcattgacaatcattacgtactttttgttggatattaatagcctgccatagttaaagtgaggctatagatcttctccccattaacatcactaccagctataacagcaagactcagacaatattctacttcccattaaaataatagcaaatagacataaaataatttgatatccaattctgtagacccagacaaattcagctccctttgcttctaggtgctacaacaacaccttgcatgaaggtttacttgaggcacacaagacaacattctagtagcaggattcagctaaccaaaaatccccatcagtggctgtccacaggacaatttacaaattgaacctacagtaccattttttctaagggataatattatagagcttactagatgcttatgttttctttatgctaatttgggaactcctctaccatatttctagccaatccacatatgttgtacactattaatttcaccaatgagaagtttaatgttaattaacaaagcctctggtgctcattggagataaactcctgaggtgattgttacaatcacttcttgattagaattctttaaatgctaaattactattcctggtctatgtatttccaaatgagggtaactgaccacctctacagtatagattaagactaactgacccatatatacaccacacaatttatgttgaagtcttatgaaataaactataagtaacagaacatttgagatatcatgtttcttatggccttggaaaacagtaaaagttgtaagagcaataggagggtggtggaatgaacaatgggacagaaattaggagatctgggttccagtctcagctctgatatccactgcctggatgaccttggataaatcacacctatctctggctctagtttttatcatgtgtaaactagggaggttcttctggatgatgtttgtgacttctatctttgacattctatccactgggcatggcagctcaggcctgtaatcccagcactttgggagaccaaggccggagatcacctgaggtcaggagttcgagatcagcctggccaacatggtgaaaccccgtgtctactaaaaatacaaaaattagccaggtgtggtggtgtgtgcctgtagtcccagctactcaggagtctgaggcaggagaatcgcttgaacccaggagacggaggttgcagtgagctgagatcgtgtcactgcactccagactgggacagagtgagactccatctcaaaaaaacacaaacaaaaacagcaacaacaacaaagacattctgtcattaactcttgtccaattcttaccatctcatttcatttcttactgagaaaaggccatccaaaatgaagctcctcaaattctatatctagaaattcctcttcatattcatctactctctgcctttatgagagcctgtgataaaaatattgaatccttgaaatcaatggttagtgtttcagccagttgtggcttatccttgcacatcccaactcttccacttactagctgtgagaccttgggcaagttacttaacttcattgtgccgcagattccccagttataaagtggtgatagtaatagttcttacctcataggattgttgagagttttaaataaaataattcacaaatgcatgtaaacacttagagcagtgccagggccatcagtgagctttcttcgtgggccctggagtcaagagcccgagagaggccctccatactgttcattctcctctggagcaggcactgccctggcacacaaatggcacatacctatttctttgttcttttctacttcctagtgaccacttagcagttgataatccttttagtcacttgccattcatatgatgaaagctcaacagagatgcacctctggaacatctctgagtctaggcaattcttccactaatatattacagtctcttacagcattcagtatactttgtgcaagagctactaaatgcattctaatcttggctctcttactagccatatgaccgtgagcaaattacagaacctctgtgagcctcagttccatcatctgttcaatgagaataaatataatagtaactatcttataaagttgttgtgaagattgggatcatccacgtaaaatattgaccataatgtctaacatatgtgttcaatatattaacacagagtagcgaagtggttggtaaggaatagaattagtcagaaccaaactgtggaagatattcttaactatccccaaagcccttcaaactaacctgtatgccctgtgaatttgtagctgaaaagaagctggatgagatcacctttgaatacccacaatgctgccttgggcataagaggtttgcttggggacaaaaaaaaagtggggaaagaaagaatttgcttgatacctcaaaaaagccagggcacacataccactaagcctaatcatgccaccattaagtggaattgtccagaaggacatgatcccttctgatattttttttctctaaactggacatgatttgggtaaagcagcatggatagtaatatgataaccttagcacttgctggctcaaaggaaagaataatctttcttcaaatgtgacctctattttaatgtgtttaaagtgggagcatggaagagtggatcccagatcctggatcctgatcctgcactcagactaggaaaaatgtagttccaactgggctctcccagccatgagttttctgagttttttaattaaggctgatgcgtgagtggaagttaagaacgtattcgtttgagtggatggatttttttcttttgatgttgcttgcctaagtcagattgaaaatagcaaaggaaggagatatggaaaagattaaaagagaaattttgctaatgtgattttccagcattttagtctctctctattctctccagaacaaaggttaactagctgattccataagcatagattcatgagaaaggatcctgctaaggaccaccagactttttagtcttttaaatttttttttttttttttttttgctcccctctcttcttctgtattctgtatctaacagcatggtgtatccagcaggccgaaacctgggttatgaccaaaggcaatttttagccacttcctatcccagtgtacccataatccatgagtatcatctcctcttctcatttcctattcaagcctattcctatattttcatgtggaatcactgatctttttttcagatgaagaaactgaagaggaggaacagagatgctcagtgactagcccaaggtcacacagctaattgataactgagctgaggttgtaatgcaggttttccaacttttggcacttctctaagatgtcttcccaacataatccttattctcttggctttcactgctgcacaatgacatacataaaaatgacaacactgtcagttttaagtaggtggcagagaggaagaataaatccacagcaagttaattagaaatacagtaaaacatgagtttcaggcgccacaattaatcgtatctaccatttagtgcctccaatgttaacctgtcatagtttaccaccctctgatctatagtcaaaaatgagcaaaacaaagtcttgaagtcctattacagatcatagaccgttggagctggatcaagtagttttaatctaattacctcattttgtggatgaggaaaataagaacaagaaaggaaaagagatttgccaaaggtgatgcagctccctagtagcagaagtaagttgagcatctagactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaagttttaacatgtgttcagatttgtatcctgcctttttactttatattatattggaagcatttgtccagactctttaaatgttctttaaaattttgatttttaatatttgtgttactgtatcacagttattttatgacacatatgtacatataaaaccattaccttatgtacatatatttatatattttatatatatacatataagtcattatatatgagcccatatatatacatatacacacacacacatacatacacacacacacacacacacacacacacacacacgcaaccattatacaactttatgcattgaggtggattcccaattcactaaggcttactattatacctcaacttcctctaatgcctacattctatcacagatctgaacacacagtaaatatgtaataaatacttgctgacttttagtttttctggtcttttttgggatgatcattattcctccaccgggtagggcaaccaaattgagaacatgactttccatcctctttaaagcacatgttatataactcaacaggcagtatagcaatggtggttatgatcagaagccagactctctgagttcaaatcctggatctatctctttcttgttgtatagccttgggtgaggagcttaacccctctaaatctcagtttttctttctgacaaatgggggaaatattagtatccactgtggtaaaaattgaaagataaaatatgtggaaagtgaatactcaacaaagattagttgccattattattacatttgccaaagggaaatagagtacagatttggagtcaaaaaacttgagttcttgttccatctctgctattatctagccctatgtccttgcatgagttattttagtagtccatgtctcagtttcttcatctacaaaatggagatagcaatacttgagctgtatagcttatagggatgttatgaagattaaatgagagaataaatgtgaaagtcctttgaaaactatgaagttaagtataattgctaagtatataaaggtagatgtaacatgattgtcgtatggtaggactggagatgcagagggtgcaggagactaggctgaatacagtgagcctgggaagatatttttaaaataaaattccttgtattggaaatatagactgttatagacagaagggaccttagagatcatctagtccgtcatcttaatgttatatttaagaaaaaagattcaaagaggagagagctcaaagtcacaaagccagtcacagaaatgaaactagaattcatgtctcttgatttcccaaacacattcctaaagcaatcactgcagatccttgtttgttgaccttcatcaaaaaaaaaaaagtagtaaagaaaaaaatacagttatttgtggcatccatgttggtagtaactgattatttggggttttatcacaaggataagccacatataacatagctttattatatttttaccaactttattccaggtgagaaaagtaaaggcgcaggaaagtgatgggtcgggggaggattcagtcagggcgaatgacctcagacttggccagattcccaagggattgctgtcatccccggcaatgaccactgtagcacatggtctttctttgattgttaatatttactttgcagtcagtccttagttatgtgtttttggaaaactcggtatagtagatgaaattatcagttgcttaaaaatacaattgccaattgtttgattcatgtaaattgattacagtcagaggactattcattttatgctggcatgcatacagcccacgtcaggcaagggctgcatcactgatggcagctcagatatcgtcgcatttcctgaattatatcccgtcaggtactcagtaaatatatgtgttggatactttcatctttacatttttttagctgagatgagagcacataaacatttccatctgacaaccttttcaacttcaacagcacagaaggttattttcaaaagaaacaagaaaggagtttttcaatagcgagctccaaaggtgactaaaaatgccttccaacaaggcagaccattaagaaatgtagtgtgaagtgtgttaatacaataaactcaaatgtggtctcactagtcttagctcctcagaatgttggctgccttccccagctgccactgtggcctggacagtgtacatcaaggttcaccctctttcctcaatcttgaagtgccccctttccacccttccgctgaaggagacctatggccagaagcagcttcccctcaccttgtcacccccacaggtcctgctgaaagggactacctgccttggccaggaagcatcagggaaaacaattggacagctctgccgtgctgcaaagatcatgggctgctgcacctaaaatgttcaccaggtgggcccgccaaaactgggcctattgtatctggggtaagtgcccatagtttgaaatcagcaaggtggaaggaaaggggaaagaatcttgttcaccaattcctgttatgccgcaaagaagatctccccactctggaagcttgaaaggaacaaattccaggcaagtcaaagtcaagcctactttacacagtgggaagtaaacatatggaaccccttagcccagagttggtgccagctgaaaatataaatactgtcagataaggttcaatacatttatgactgttaaggcaatgataggttattaaaggaaacgaggctgtttggggacatgttaaatctctgagctcaaaattagtgaggacaagcggatcctctgacagcctcagtgaatgagtcctgaagatatacatggtctcagaactgtgattgtgttctccaattaagctaggaaaaaataaagatgtggtatttagggctgcttggctcaaactgagatgctaaaatctctggtttgctcagagttaaattcttcaatacatgtaagggaagcaatgcgttatggaagaaaaaaaccctagtatcctccctttgcactgctgctactaactagctatgagactgccccctctttaggcctcaccttttcccatttgtaaaataagggaattagagtaggtgatttccaaggtcctttctagcttcaactaggtttaattcaaatgatatcacgaggttcccttgaagggtttggagcgggggagatcctgcatctttccttgccctcccttgctcaggagctcagagtcttcaagatgtttgaaagatgcccctgattctaccaagacttgactccttcaagtctggcctccacagcagacgtccatgctctgaaatttatatctcatggcctattcccccactcatcaagctcccaattgcctggtaaagaggtagaactggttagatacaggggtttgttttgttcagtgcgatagcaaggttggagaaagtttgggctccaatattagagacagcattgtatgggctttaaagctagagctagcccgggttagaattctggttctgccatttctgtgctcatctatagaacttatctcatctatagaattacagtgataatactgtcatccctctagggtgattgtcaggattaaatgacagaattcatatcaaatccttagcataatgcctgccataaagtaaatgctgccactagtgggcgtcttttcctgttctccactaaatagatgttgagttaaaaattaaaaccaataaatcaataaatattgagctaataatcaaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgcagtggttggcggcactttactgggagcatcgggtagaaaatctaatacataataaggtaggtcaggctgatagcattactatatccactttacagtttaaagaaacaggctcgaaggagttaaagtgtttttcccagtaagtggctggggtgagactcaaaccttagtctaatcttatgctccttccatgcaatatgccgtctccattcaactagcattataagggaatgagtggttctaagctaattttccagatatttgaagcacatgtctttcagcagtgcaagtgctatttttattttaatcatttttgaagaaaaaactttctacaatgcatcaaacacctccacaccttattatgcagaagatacagattactgtgcttttaattttctgtctatttccatagccttctatctcttttcccactgtagctgacaatgttcagtacttcctaggctactgaagatagacagcatattagaaatgaagcactcctaaaagtagatatactaaaatgtgacagctgacaataagtgaacaccatgcagaatcaccaactacaaaagcacaacagtctgggattaattcaggtaggggcaaatagacctaagaggccaagtaaccgcatggacaacgaactcagtaccggagctggagttgccagtaaagaccctgaatcatccatagaaaattgaattctgttcattcttctgcactggtatactgtggggaaggggtgatatatgaggtccatcccagctgggaggagtattttttcactgatatttagaaatgcctgtgcatatgataataaaaaagcaagtagacagtttattactgtctttaaattctctacacactaccctcttattgtttgcaccccagacagaccactcctactgctcctgcgttggtatgccagtgctttactgtgtttaaaaagatggtcgtgggggagggtttccactttagaaagatatccactatctcaaatggctcaagatttggtatgtctaaaggggtaaatgtttactgatctggaaaacataactcatgtaagaagcatggcaaattattgtgtgtttagcctgtcacttctctttccttgttccacctgtaatttcaaaggaaaaaaaataacactacaagcaaatcctccatagaatgccatcctattggcctgctgcaagtacttggatcttttcaaattccaatcagaatgggccgtgctttgccttctccatctctgtctcctctgacccggcaaagtttcccatcttttatcctgtcacttagctaatggtgtgtgtccctcttgcatatattccatagtcaccggcttctttcgctagtagagtcgtcagcgagatgctcggcagatggctcactggctgccgttcttgtcccctcactgcagcaatctgctgttctaaatcaaaatgttaatgaaaaataaaagaacgcagtgccaatgtctgtctgatttaaattaatacagagtcatacctttggaggcaggttttactggcacgaggttctccatacaggctacccatattgtgtgtggcttttttttcctctctaattaaaattaagcactttcatttatctgagtctctcttggtacccccaacctgttctttttaataataacaaagacctaacaaacagtggattttagtgttccagggaatggcatctcacctggtggaacataattttgagagatattatatgtgatgtctaattataaacatactttgattggattctgttctcaatactgaaatgacacatttactaaatgcttcaagtgcagctctaagttaggcatgtagttattgaaatctctttcaatccatttgttttaaaactggtggcaaaatcactgctaatttgctactttatttacaagggcccttcactttctatgtactcagcacagtattcatttctgttgctgcaacaggactgctcccctctttggggaaaatgtatgtgtctgcaagattgactatgcaagacaaaattttaacttcaatttagagacgaagggaccacggtgatgttaacagacatggtggaggaaaatcacctcagtattataatttgcaaaaaaaaaaaaaaatctatgaaccaaaagaacagcagtttcaactgattgcagaagaccacacctttcattttttcttcctatgactcctttgtagatactgctaggaatagtattgagaataatgagttaacatagtgcttcttacataccaggcatccttctaagtgatttacatttatttattgttccagtcatcaaaattctgtgacttaggtctatttcacagataaggattctggggcacaaagaagttaagtcacttgcccagtcacataactggtaagtgacagagccagagaagaacacagcctggccccagagccttctcttttaaccactataccattctataatgtgctgaaagggccacgaaatccagcctacttgaaagtaagctactgtttcctttcagattcggcaaaggatattctctttgctgaaactgctgtgtaaaaatcaggtttctacttcagtggggcttggtccttgttaaatgcatgtactatttgcatgtgtcaccaccattaagattaaggtgagccaggtaaattaagctgaagcagcaggcaggcaagcaggagaaaagcctgggttttcaggtgggaactggggtgctagtcattaggtcagtcatctcagggccacctcacagttctgacaagagaaggccaaaagaggtaaggcctacaaagcccacatttgaaccagccaagtatatagggactccctcctggaacacaacaggtcaggtcacctggcttcaaactcagtacttattcctacctacaggcagggccaacacacaaaccaaacactattgaagatcagccttcctcctgctgctcagaagccagctcaactggaaaaacaaacaatagaagatgattatctctaattaaatatatgcatcccaggatacatttactggggtatcaagttattcaaaagaaaaagcctctagtcggaaggggctaagtagagaggcagtcatttcccttgctaaacctcattttggtggttgcatttttctggccttaccagggactaaatgaaaatatgagatttgaaaagaatattaccagacagcaggataggttacacagaaccctgggctgggagccagttgtcctgggttccagccccaactctgtttctaacaaaccatgccttctctgggtttcagttagatcttttgtaaaatgaaaagatcctgtgagggcctttctaacattaaataatttctgattttagccacctcccccaaccaccagtttttaatgaaagatgattctccctacagaaacaaggaaactcagaggataatttgaccaaatgaagcaaagatttgagctgttttggggtgtttccaaggaggcaactcaaaccattgaagtcagaaagtagatttctttttggcctgatctctcccagttgatatcactagataattgctcacccctctgagtcatcgaatcataggctgattgaatctctgggatataaaggaccttaaaggtcatcttttcccacctaccctcagagatggactccctttctccaaacacagctagtctaagtagtgggacatgtctgttttataaagcttgtgtatatacaggtgctgcttacctggatggatgtcacaggtcattggaccctttgactcctatttccaaatagctctcactcctgctcactgataccagagcatatttaacagagggactttcattctccactgaaaacatatgatataaattccctttgaagaggtggcactgtctaaattcataatgcaatgcatgcaactctatagcagatcctatcatgagagcagatttcaataggaaaggtgcccaaagacatggaattcttgaagagagtgaaacaggtttcagtgagaggtaaaaattatatagaatgggaagacagcaagggtggaggccctagagtgatagtctaatagaatgtgtaacaacctgaagtcagacttgggtttatagctcaactctgccacgtaactaaccatattagcttgtacaagtctcaacctccctgaatctaagtttcccaaactgtaacacagggataataatatctactacataaggctgttgataattaaatgagataattattcaaaggcataatgacagtatgcttgatttaagtacattttcagccccaaatctacaatgttgtcatagtctgatggcctttgatgtgtttgttcttggttatgcctctgcaacactcgtgaatatgaataatgttgatgaccatgtctgcagccaccagtacaaattttaactctcttactcttctatgcaactaactacacaactgattctagtaccagccaggatatcaattgtcaagcaactgaaatgcccacctaaactttgatcaagatttgcaagcacaaagagattagctccatgctcataatttcagaggagctcatattttcaaacctgtttcaatttagcccagttaataggacttcaaggtagtttccctaattaattagctccaaccaggagtaaatatgtatggtggctttttgaaaaatattcccaaggtatatttcaaccttattatgggagaaaaaggttaacaaatgggatggtaaggtttcagtacaaatttcaggttgtgtgggggaggtactgagtccatatgcctgtcaaaaataatgacagacagattacaggttgcctctgaacatactgttagatagccttgaagcccccgacttctacactattattagcttaaatgctgtcaagcttggagttgggttttaccgtgattttgtttgtttgtttgtttgttggttggtttgtttttctctaggaggtgttgttggtttggagaggctcatcaactccatgatttattattttctatcagagaaacatgaaagtttggggtccagcattgtcttccttttcaaaaacatgctcaaagctccatattaaaaaaaaaaaaagtttcaacctgctcctttttttttttttttgccatcctccttttgcttcctaaatcccctaatctgagatttgtgtgagttgcctttatttcctatcccacattctgttcctaactcctacactctgtttctattctcactaatctaccaacatttctcttttgagttcaccagtgatcttcttgccaaatccaagagctgtttttcaattgtttatcttcctcaatctctttggtgtatttgacacactggttttatccactcaaagtatctcttgccttagcttctgctgacacttcactttcttgattctcctctgattttccatctaattccctttttgcctgtaacattaggcaaaaatgttctccttctcctttctgggcatgagtttcttcctcagtaaaataaagggtttagacagggtaatatccaatgtccctttcatataaaacattctatggctctgagggtcagtgagttatttgactttaacatgttatcatgtttttaatgttgaaggttttgtagctattccagtcgactttagtgttccagtaattgatataagtgtctgaacttcataaggctaggcctttgctgatttatacatgtttaatacatgcttgcttttcttctttatctaagactatgcatattcgaaatacctagatactacactgttcctttcttgaaaatagatgtaaggtacattctagaagaatatcctgttgcttattattaatactagtctttcaaaaatgtatttggatcagaaatccttcatcttgttccatttaatttggatatttagaaaatgaaacaacaatcttttcagccaagtgaaggcattatgaccaaccgtgagagccagaattcaccaatgtcatcaacaaagggtcaaaaataatatatttgacagcttaatactgaattcatatgttacacagaaataggtggtaatgctttagtgaacccttgtatatctctgagaaacataacatcacttaaagacactcaaaaaaatgtaaaacaacacaatttctattgatacttcttttccttcacccatattttaggtgctatacgtgatactgccaagagttgcctgagaccccagggcaaaagactggctataaataccttacaagtcatccccacaaatccaccaaataagaagtttcccttctcctaattaaaaggcagtaatgcaattactgatcccaagggtatacaataaatatatgtcagtaatgagaaggtcagaaaaagtaaattgttagtgtacaaaatagaaaatgcctgtccctgctaaggaagctagtcaagagtggggattagggtcctttagctgctcccaatgcaagacacataaaaaagtagctgaggttttgttttcttatttatcaccaaagaatatatgaatttgaaagaccttgcacacaggagctctcttgatccatggaacataaacatgtcagtgtcttaactagccatgatatactatcatcttcctctaacaacagaaattcagtgacttatgcaaagttgtaagagtcagtggctgagtcaacagtccccaaaaatctctgtcaaaaattcaaaacttgttaatttatacaaaatattacaatgactgccactctcgctctttcttcgtctccttctccctcttcctctgcatttctctctctctcatacacacacatactccaccctacctaagtgcttctcaaagtcaacatgatgggctaatttttattgtaccgtatagtatcgttattgagcatggactagagcattcaaattaatagacttggtattcaagttattagaaaccactaaatatgtcatataaggtttaccaatttttaagagttagaataaaataaaatttactcatgactaaaaatatattgtgtatgaagttatctttcattgatgattcagcactgctctggaaagacttcacacagttaagtaaaagacaccatctttggaatgacaggaccatgaaagtttgttctaggtaaagcaactgatcctaaggtctctgggaaaagaaacaacctagattatttctcaagtgagtaaacattgtcagaattgttatataaaatgctaaaaaaaaaatcttaccttgagattgcaaactcaaatattcttgacaccttgccttctattttcaaatcagaaatcccaactttctgcccttaaaagtaatattgtggtatctcattttgtagatcagaatgtttacttctctagaagtatcttcatcttttgggcttttaagatattaccctgagaggtcaaatttactatatggcattgtcacaacttcaggcttaaataggttcaacaaaatgccaatttatctatcgagagctctaggtgatattgtgtgaatgacaaagagtttgctgttgtgtgccaagagttatatttaggtttctggcacaaattaataattacttataacattttataaaaacaagaaatcatcttgacagcctttcatccaaagcaacatcagtcgttctattagtattggagtttttgcagtgacaaggagaaaatgatgggtaataatatcagaaataatagcaaatgctaggcatttgctaaatgcttttacatatattatgtcacttaaatcttcagcaaacctatgacataggtactattgttagctccaatttacaaacaaggtcgccaagacctagagaagtgagggtgtccacagcaggggtccccaacccctggtaccagttcatgacctgttaggaaccaggacacacagcaggtgagccatgagcttgcattactgcctgagctctgcctcctgtcagatcagtggtgccattagattcccataggaatgcaaaccctattgtgaactgtgcatgtgagggatctaggttgtgtgctccttatgagaatctaactaatgcctgatgatctgaggtggaatagttccatcctgaactcctccccaacccccgatggacagtccatggaaaaattatcttccatgaaaccggtctctggtgccaaaaaggttgagaactgctggtctacaggatcttttgctcagacaaaatgacctgggtgtagaattgcattggttgtttcatatgacagagcattaatgtttagtgagcatctaccatgtgccaggaactgggccaactgctttacataagttgccttatttaattctgccatcagccttatgaggttgttacttttaaacatattgtacagatgaagggaagaaggatacaaagaagttaagaaattttcccaaggtcatgctactagtgagggcggagctgggatgttaatctagataggtttgattctacagttcacactctttccactatgaagtaaaaatcaaaccagcaaaaggcaggaaataaatttagtttaagaataatttccatattgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaactctttttctggggggcagagagatggacgcagctggtcacagaggcaagccaaactgatgcaaaatgcattatggctaagttaaatcagagaatccaaggacacccaatgtcatctttatctgtccagaaaagccaactgctgacctaacccagggctgcagttccagggctcggttccagcaaccagcacaaacccagtcacaggctgctttgtgctttgtgcccggtgctgtactacatatcagctaaagccagtaagctgagctgacctctgctctctaggaggaaaagcacagatgaaggcaaacctctaatgcacacgaaaataagtgaaaacttggtatcaaacaagcaaataaatacatttgctcatatcattctcttctcaggttcctgttgatttttctctaagatgaaaaagcttaggtgagactgaaataaatgaacctcaagtccccagcctcccctacctcagcaacttgtcaagagagttggagattttttccatcgttatttttcaaaaccaatttcctaactgttgcatgacaatcagcagtcaaactaattggaatgttactttaacatttcttcctccttttagcattttttgtgctgtgttgtggggaggaagggatgtgaggtttcagcgatgcttacatagaaccttacctttcctttcctttcttatcactgctcccaactgggtcttcagcttcttgggtcagtgggacaaactacaagcaactgctacagtgtccctttcaacttgcatctcttctcatatctagtggggttttggggattgacaaggttggcacttctcagagatggagggaagggagaggcagtggttgaggagcaggaccagaggatgaagtgcagacttggctagtaatttcttgtaccttccatttaaccctatgccaagcctccaccaccaccaccactgaggagaaggaatgtcataattaaagaaggctctacgaatagcacagatattgtttctaaacaggaaaaagagtggtaggggaaggaattctattaagcaaacattgttggtttttctccccctgattttcttcgagaaatgtgtgtagggagagactacaatgaagggtcataatctattaaatacacggactaaactaagtatgccatctcaaaggaaaacataagtagtgtttaaaggtctggtctagtctcagctggtcagcctagaatccactggacaactgcacttcattactaacatctaactcctcaaatagccttttagtactatgtgatgctgctaaagggcaaaaggtgctgacagggaccatggacatttctgcagtgcctgtccccccggtagtgttcagatcttgcaaagccaacaaaactgcagcataggtcagctgcaaactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattcttgacccttcaaattagagcagtttgattggcaaggaatgcctttctaatgataacattttaagcttgtactaggctggaggagatggcacttgtgtgtaacggggtgctgcttgacacacctccagtcacacagtggaaatggctgcctactttaccctgaacatagcacagaggaggtgccttggctgtttagaggatggaagcaaccagctaacaaaaaaaaattgcttaatttacaaataacctattagcattgtcaagaatccactcacaggcaggtgtccatccctaagaaggctgtgtattttacctatgattcttgctttgtcttttgcacttctacctttcttaactgagtctgaggcaaagtgaagttgccaaactgttagtgcatttttcctgggtcatctataaacttgccttccttactaatgttttagaatgagtctacctctaatccccactttcttttaaggttcaagaagtagacctcactttactcaacagctgcattactgaaaatatgtgtatatgggaagggcaataccaataaacacacctcattgaatcgatctataatgtaaagaattccattattcagtaaacaagcataaggctgacctttggccaaattgaccagtaatacacagctgtggtcaaaatattatatgctcccataccagttggtaaatagctactacaccttgtcctggatgccagactgtactctgagatccctagacctccacaagatccagcagctaatacagtaatgcctgacacagcaaagggcctccgggtccttgctccagggctacagctggaacctagactgatttgttgtttcctgtgctttcctatgtgaatattatccacaatttcaaagctactgagtagcaggcactaggtgtggccatgaatgtggaccataattactttgcttaaaactgtaatagtgacactgaggtttgtgtcagttcactctgccccatgcattcccatggagcagaacgtccacgaccttcaaaagatggacgacatgagccctgtttccaaaatagcacttggcaggcagcctagatttggatgtgaacagcagacacaggctatgggcatgatgggccagccccctgtcacatcacctcaggggatcctcagcctcatgggactcactagaaaatcctttacatctgaaaagcagaaattatctagtccacctgagtgccctgggagtgggtctgtattcttagcctcatgcttccagtgctgagtttagaacaaaagcctctattcaaggtcatatggtgagtcagctactgaacagggagtgaaaagaaagggggaacaaacaacccacaacaggattagcttgagctgcctcaacctatgagaaaggcctggtcaaaccatttatagtcttcatatatagatagcttgaagaattgcctctgaagggtgttaatgaacataggtaaggaagaatggtgatagttaatcagcagtcctggagacacaaatttgtggtcgccttgtgatacaggtaaattatacaatgagtttctgcttgctgtccttatgtgtatcttaagaaataactccttcattctacctcaggtaaaagctcactctttctcccaatgcaccttggctactgtcaaccttgcactaatataaatggattcctccttgtgctaaagggaagcagaaagagccccatgtctgaatttggaaggtctgaattctactcttgactctgctaactctcttggtaacattcagggagacacattctgttgtttcattttcctctttttatcaaatagggatgacactacttcctacttcatgggctggcataggaagaaaacagtattatacataagactattcgaacattccagtaccctccaaatacatgaggaaatatgactgtctcagagatgctcaatgagtacatggaaaccagcacttatagcacttatcaagcacctactatgtgcctggcacttacacactcatagttttgttgatcctgacaacaattctatggagtagatattagttgtggcatgttaaatgatatgggataaaaatgacaataaaatatgtcagtgcattcaaattttaactttatttttgaagtaagtaaatttgatcccccttaaataacaagcttgcacacacacactaaaatggaatccaaactacaaatgacacaacagatcagtttagcatcaacttgcatttctaagataaaattgaaagtaaacgtgtgaatcattccataatttatatcacagaagcaaaatatggtttgtgaaagcttggaaaacatgtagggtaaggattattaccctggaaggaatgcataggtgtttaaaaggtagacaataagtctaaacaactcctcacgttaaaatgacatagtacaaggaggtagaaatacagcttatattgggcttaaggtagcagcactgtggggcctcccagaggggcacacagaatgccttaagaaaggtactgggtggaaacccaggtggagatataaaatgaggcaacaaagaaaggaaggctgatttatataaattttcaaatgcaagcatgtgtgagactatccaggatattgcagacctgtagtttcctccctgaccaatgacaggctacagccgaagctgaactctgttccttacaaccttggccaaaggagggatgagatgcttgaggggaggggatagagagagggtggctgttaacacttttatcctcatcttacacaaagaaaatggggcccagaaagttgtttcttcaggcatgcagctcataacaagggacactgggagtcaaacaaaagtatatatgaccttcctatacatactttgtgtaaacaaagtatatatgacctttttatactataaaaatccatgttttttccaagaaaatgcaccacttccccaaatcacattctctttctcccaaaaatggtgccaaacccttgggtgatagtgaaacattgctccaagccctttctaacttaagcgcccctcacaatgaccacaccactagtcataaatgatgaacatctgtaagcattcctacaaatgctaaatatcaccatttcattggtcaataaggggagactatgtgaccaagaagcagagcagttctctattaacaaagctaacctaccttcccaggagatcaaactcatccatggctttatcttgtctctcttctttcctcagcctcccaggcacagagatccctgaaggccaagactctctctaaaacattccatccaaatagcccccatagcatccagcacagtacttaacacatagcagacactcaaaatattttatgaatcaatgaactctgtttctcccaccatgtgtataacagtatgtccttaatgtcttcatgttattagaatccttgtgaaatttaatcagagattataatgcaaaaaatataagaaattgagatgaaggtaatagttggcttctgagaaactctcctctttctcaatcactaacctagtaacattcgttctagtctcatatctaataccaccaaccagaggaactagaagaaaacatctcagcttcaccatttttaaaattaatcgtatttagctagagcagaagttctcctccctaagttttcatgagaattacctgggaaagctttaacaaaaactgatgctagattctgttcccagggtttctggtttagttgatactgggtgagacctgagcatcagtgttttttaaaaactccccagtgaatctgaaatgttgctagggttgaaaaccactgggctagatgatccttgaggtcccttcttactctgaaaatcaatatgctgactatagctgggtgtctgttgatgtcatgggttgttctgactgttctccactttcctctctaatactgcacaccacgagatctatatcaagttgctcaacagcctaacatcttgtttccctccatttacctattgacttaaaactttgtgtactcttggggctcctaagcacaactattgagatctacttttaatgctatgtgggtcattttgccaccaaagaagctcccctggcaccacgatgtgtccccaaagcactatctggcctgccctgcttccaggcgggaaagcccaacaagcaagcatgaacagctggagtgttcccactgatctggaaggaatccgtaaggacaatgcactactttctatttcactggactctttcatggcactgagcctgcctattccattcggccctttgtcaagaatgtccttgacacttaaggaattgatttcttcttcctttcctttaaataataagccaacagatacgcaggagttttataaggtatcaatttaacatacaaactgcattatggcctttgaatgctacagcaagaaccaatgcctcatcagccagaaagaccaatatagtgacaacctaacgttttcttaacctgtcaaaacattcctgtgctctgggcttactgagagcagacatgccaaggatttagaaatgtcaaattaaaatagtctgggctattttcaaaaagacatgagcctttttaaccactagcattctatcagcaatgctttttcagaatgtagggctgctagaaggccctctttctgaagaacggtgtgaacattacacagggaacagagagtttctcaaggtcatatgatggttttctagaagcacttcaacacaaatgtttgcctcatctgtggttagatgagaagggctggaaatgtggggcaggataagggtggaagggagcacagggcaggagtctaaatgaaaaattcccatactacaaagatcctaaaatacaaatttgaaaaaatagaatctggcatggccttttagtgatacacagctaaggtgctcttcaaggatgggaaagtgcagaggtgctttgttgtagacccttggtcaaattgccaaaagtacatgaggtcattattcttttcattgccaaatgtgtgggaagagtaatcatctcaccttgcccatttgttcttcagatttacctcccatattcaccactctgctgcaactgctctcattcagacaccagtgatctcctaacagccaagtcctgtggttagttttcagttctcattctgactggcacatctataactatttgatactgttgaccatcctttccttctctgacttctgtgatggggtctctctctagattctcctcctatttctgtacttttattttcagttgctttcttaagctagtcttcccatatccagctcttaaatgatggagatttttcttagcccttttctcacttttgcaaaagcttccatgctatgacttacatgattctaagtctttatctcttgtcccaaaatccttccaaactctaagctcatatagtcaacgctctttttggacatcttcaacccaacagacacttatccccattcccagtctgctccttctcttctattatttcagtcgctacaataactttctaactggtctcccaactggcattctttttctcatctctaacctattctcctcgtttttttccagagttttctcttgaaaacatagatatatatctgacatttccactctgtttaaaaacttttatcggggcttttttctacttataaaataaatctactcattatcccataacattcaaggtatctaacaagccagtcctgttttacctttctagttttacttctgatatctcccctgtcatccctactacttcccaacacctcaatcccacctatcttacatatttaaattatctaaattatttaaagcagttaaatatttaaattttaaatcatttaaatatttaaatgtaaatccttaaacatgccgggctagctcatggctcaatgctttctttcacactatttcttgtagctggaagaattcccccttcccatatccaaatcatagttttaaaatgtcaccttgaccaactaaaatgtcacctcctgtgtaaaatctccaggcagaattaatcgtggtttcctctgaactttctgcaaaccataactgtagcacttatgcacattgttttacaattaggtgcgtgaaacctctttaaagatggggattctgccacagacttcatgtttaatatgtctggttctggaatcagagacttggattttagtaccagctctggcacttactaggtatgtaatttggggcaagtcaaccggtgtctctaagcttcaatgttctcatctgcaaaacaataacaatagtgttgcaagtaaatgagataatgcatacaaaacacctatagtgcctgacacataataaacactcaacaaatgttagctatgactatttttctgtgcctggcatatggtcttgcacggagcgagtacccaataaatgattactgaataaattaatcatagcatggaagacctaagaacatttgctaaatggacagtttcttcctttattgaatcttggaattcctgtcagaggcataaaaaatgggttacataatgaatttatttctctgtagtcaagtaataattacagtagcaattgggataaccaaaagctttgtctgtgcagtttatcttttgaacctgaacctattacatctttagtcccaggaactacatgttttgaagtgtacatttcaaacttcctttccaagataaatccaaagactttttttctactctaacatttcacaaataggatgaatcaattaatgtgataattatttaatacaccaagcaataacttttaaggtgtaatggtaattgagcccagcatgcttgaaaataccattctctgagtcaggttcagcaacatgtcttgaagttgggaccttagaggcttaattcattctaaaccccctctaccaatataaaatttaaattaatggtatttctgactcttggtccctttcacctataattcttcttaatctcttgacctctatttcattcatgaaatcccaaaagattatctttcacagtgaacccacagtaatctgtttaatatcccttgataagaaatatccctttaaaaagccaaattctgccatgctttaaatagaaaccctatttgctgagacaagacaaacacttatagtctttttcctttacttggtcctagaaaaggcccaaaataaaacatacatgtcaagtccattgtaaatggatgtggaaaccagacatttgaagtgttatcatcaccatcattagcatcatcatcaccatcatcttcatcatcattatcataaaaaacaacataacaacagttcaagaagtttggaaaatgaggatatgggtttatctaaaactccactacccacataaaactagaattatttttgtatatttttccattctttctcattggcctacattttttcaaagcttgctcccaagtattcccaggtataccaaggagattttaagaacttcagaaaaactgtgattctaaatgtataactgcctagaaagtttcccattgcttcagtttttcagagaaagacactctgagagtacagatggtataatggcccaagtctacaaaaagtttcatttctgtgcatacataccacccattctacgataaggtgttggggatcagctgatgagctgaccaaacatgcccataataatcctggacaaaggctgagaccagcactttttacttcaatttggactctgaaagaaaaattatatgaggaaaggtgaggattccctaatgataataacctcaatcttcatgatattaaaacataataattaaaaggcagagagagactttaaaaaccccattgagatttcaaaagaacaatacaatatgcaaatagtcattcttgtatgcagttcatcattgattatccatgagaacagaaaggagctgaagctttggggcatgttcagtaatatttatctgcaacttctagcttcctgtccctctccctgaccccctccaatacacacacacacttagaataatatttattttagattatgttttgtatgttcacgaaaatctaatatgaccactaataaaagctgaggtttatggccttgttacctttgtctctcaaatttatattccttcattatcttctgcacctcttgaaaaccacacagattcctcctcctctttttcccttttcccacttatctaggctaaatgatttaatactgcattttataatattttatgttgttcttgaatcatttaatgtcacttaaggttacttccttaactggatcatgagttctttgacaatttatgcatggtacctttttttctatctgctgtgatccttgtgacatagactatgagttacttgaggccttattttcctttgtctcctcagcacttattacagtacctaacagtggagctattcaataaagcaaatatttaataaaggaataaatgaatggacgaatgaatggatggatggataaaaagacagcatccaagaaatgttacctagctgatgagtggacttcagagcacttgccagcaagaagggtggccagcaagtgttgataagtcagtcagcaattacttattgagcacctactatctgccagacacagatattctgtgggggaaggggaggggaacaagagaaagcaggcctagaattgaaaatcagatgtgtacaagtcacaaagtggaacacaattgcccaattgtctgactttttgtcattattttctgagtgtagcatgggtgaatatttttctctaccatgaggcaaactaatttgggaggcagagtattaccatcttttctactattctcttgtcttaggttgagttgaatagttcaagtattgagatgtgtagtttcttctgtagtatcttccctgctctgtcaccatccttttcagacaatagaacatgagttggagagacattctgagttctagtgaagtcactgaagccaacttgccaatgagtaagaggtaaagacctagggtgtgaggaaggacttgcattcaaggctgtttgaactttccgtgttaagccttcgcttccattttggagactggagcctttcagctcctcctgtccttctggcaactcttaggaaaaaatgcttaaataacaataacagagcagcagaaaggaagaatggaaattatcgtaatagcatggacttgttgcgccaacattgttagcctctcagcagccaactccatggagctgccctatgcttgtcaatgaaaggataaaaaggatatgaaggagacattttatggggccatttcagctgttcactgtaaatacaccctccatcaaatatagtgagctgggacctagagatcacagacagctgggttgcttgaaaagagaaaagacattatagtaaattgtattattatacatttactgagttccagggtttctgggagggcctcaaagatccaagggagcatttccaaccagtggcttgaagcactgccaggctgggggtaagctcaaggccaactaatgggtccaatgacatgagactataactctggtggttgcgaatttggttaggggctagtatggacatttttttagggtagaagcacttagcaggtgagccaaaaatgaatattttttatagaaagattcaataacaccattgagtgtactgcctggcctcagtgatgccttctggtattaaggatccattcaaaagcagatgtctaaatctgaggttttatgacaatgcctcaccatatccaaaatcattcactctcatccctcacccctcagtaactaggcaaggacacataaaacatatccagtccaaaggcacaaatcaggcagttgtcctagtagggttggagaaggtgggggatcccttggattgccagagacctatgaaaatcagtatattgctgatggagtgaagttagggttgccataggagggcagttcaacacagaggtcagtaaatcagttgatttaattatataacacatattacaaaatggggccacgctttattgaagcctgattgccacaggcaacacacttgcttaattcaaaaggaggaatttctcgctggggttgaaatgctagaaactctgtgttcaacacaccagatcgtgcccatctccatgatgggtagcaggaattggcagtggaaaaaaatctgagagccggaagatttcttacagattagacattgacccctactcttgcagatagaaaaactgaggccagcagtgtactcaagggtgcattgcaggtctacaattcaggtcctgactccccagattgatgtgctttccattataccatattacttctcactgtatataacattcatcatgatgaccgtgaaactgtaaaagacttggaggtactttctgatttattagagaaaaaccatagtctgttccttctattgccagtctgtcatgaatttcatcacagttactttttttgcttttttgtatctataaaaattatttattaaacaaaactgtaaattaatctgaatagcctattccctaccagatagcacatcatgttaggaaatgcaatgtgctcgttccctcagcagccatctcctggattatttaggggatctgtgcctctgtccaagacctagggaaaagaaactgggagtaaaaacagaggccagctttcagagcaaggtgcttgtctgggattatattttctctttctttttcttccatagcacctaacacattgtggggcacacatttgtatccataactgctgattggttcatcacagaaatccccagtctgtgatgctctgctggagatagaagagagggtcattggcttagtgagataagtcattgtagcttaacagaaagataatagctcttgtacttatatggacctgaattgagataacatatgtagaggcctagcatggtatctgacaaatagtgagtgttcctcaaaaggtgttcattattatgattatcatgatgcaaaatatgtgtgccagaaggactaaagcttcccaggggatctggatcactaatcaaatgctgagggggaagtcagcatgctaaaacttaggagtctttgctaaatgcatgatttggggaggaggaagaaaaaaagaattcccagttcctctactgaaggaccacttttcagcactttcttctgaggtgtgcaaggtctgttgtcactgtggagtagttccagatggtttttagtacctcattggacttttggtgccatcacgaagtggaggaggccaatgctcccatgttgaacattagttacttgaggaaagcttattgcaatactccctaatcttctaaatagtaccccatgttctgcaattttcctaattcacccttaaagtcctaatggaaactaacccatcttgtgtcatatgcccccaggaccttggccttagttaatacaaaaactaatttattcagaagtgttaacgatcactaataccttgtttatctcaggtgatccacatatattttcactttcatgaaccctccatgtcaacctaaaatggtttggtagagatttctgacacctgagtaggctggtgggggagatatttatgggcatataggagcattttggtagtcctcaaaccatatcatgtgggcagctctgcttcagatcattctagaaaatcaactgggtataaattataaaaataacaaaaagagaaaattgcctactcaacctatgtgtagggcttcccagctgtcactttattcaattctgtagatattttgaacacctactctgaacctggcactgtgctgactgctgtggatacaaagatggctatgacacatcattggaactcctagttctatcatccagctggggccctaacaaaacttagagctacttatttggttgacaaaggaaataaaacagcagacaaagccaacagctgtttgcttataaccacttataatcagagacgtctctccctggtttaaatacttctctttatctcaaacacaaagaggatgaagatatccatgtgaaaaagcctactcttaaaggtaaaagctaaacaaagaacaagtgataagagaagtgaattctgcagtgagcaaattgctagtcttttcagaaacaaacctacacggtctggtaccaggaaatagcctttgatgaggaatccactaattaaacctgtttttactgtgactattcaaaacattagcaccctggagatctctggaaataaataaaaggcagaaaatcccaggcagtttaacagaaatattttctcccactggtgagaacgataaacccgacttcaaaggaatcataaaacattcaagccagaaagaaccttagagatcattggattctcatttttcaggtgaggaaattaaagctcaaagaggcccagggacacacctatggccgcacatctagaaaatgagctctgggactagaatccagagctcttgaatgctatttattcatgaatctggtcagtcggtcaactaaatttcttgagcaaccactatgtgccagtcattgtgctacgattggtccctatccctgtccttataaagctggaggaagcagatattaaacaaatggcaaattaattatttataaatgtaatccatgctgtaaagattaagtagaggatggaatgaaagtaatctagcctttttgagggagtaagggatggcatggcttaggctaagaaatgaaagataagggcaagttccctagccaggtaaaaattgaccatgtagttggaagtggaggtctgagggaagagaacattctagatggcatatggaaaggtgcttgcagtccaaaactatcccagctcccccatctgcccctctcaaaatccagacgtctcaccctttttataaaacagcgatctacagtatatagagatatattttcagaagtatgggtgtgtagtaggaaggaggcatcatagccatctggacctattaaaatacttattaaatcacttcactgattaaacagttatttttactaaccaatgccatacaccaaggcagataatcagtgttttatgcttctggaaaggtcacatcctcatccttttgcatggcacctggaaataaaataagcctatattcaaagcagtagatgttaaatgatgcttactgaaaataagtcctcactttcaagtagaaataagaagtaatggaattttcacatatgtatgcagaagatgacatagcagtaggtcagcaggcaacaaccagaccttaaccccttccagctctcactagaagtaccctgtccacaagggcaagcaactaaaactatgtagcagttgctaactccacaaggggtttggagtcctgcatcccaaatgaaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaagctatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcctcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctggaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccatttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatctcccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcgagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccactcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatcttccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgagccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaaataagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaagctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgctttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtaactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttagtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccatagttgaaaaagaacgcctcccccatcaaaaattttatctggtctaaaatgtatgaagtaaaagcagcttagtctaagtagagagaggcttaaattggaaagttttggaaaattaatcctgtcagaaactgtaattatccccatttcatagatgagatagctaaagtccaagtgctttttcatacagcagtttcaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctactaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggcttcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggaaaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaagcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaacaggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaaaaaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacataaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaaaagcaggggttgcagtcctagtctctgataaaacaaactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttagaagttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttattgcacatttgagcccccagaatcagagtcgtgcttcacactacctatcataacaaatggcatggaggggttctttatgttacaggttactgagttggatatttaaatagcacattcggaagtgttctgagttatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacacttagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagatctcttctgtatgaccttgagtcagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaaaaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttacttatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttaggaaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatgagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcgaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagagaacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtgggtttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctttaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctaccatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagcaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacatcatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagctccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgctcttatatgtaatttaatcctcacaacacgcctctggggaaggtgtcattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcatttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcatttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcatgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgt

SEQ ID NO: 968 - DNA, 237057 bp, mus musculus; identical to SEQ ID NO: 967

SEQ ID NO: 969 - DNA, 97077 bp, mus musculus
ttttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccgccggtttagagcaccgctgccagcagccggaggagagcaatgcgggggcccgagcggcagctcgaacagtaatgtggatttacagtcgtttcccgcaggagtcggccgagacgccctaagtcccgggcactggcagcgcccggcggagccgagcacctggcgagggggcgggggaacagcacctggggacgccgccgaaacttgcgcttggaataggtaggtgcgtttctcctggctcccaccccattccttctcgctcccgcccgccacccccaaccttctaccccaaggactacaggcgaacttcgccccgaggctgcaggcggcggatggcggctcctggctgttagcggccggttgagtccgctctgggactcctgcccgaggtggcagagcctccgcatccttcttctcccggtctccgccggccatggggctctggaccatctggggcagaagggaggtcggccttgttcgcagttcaagcttccagcgggccctggggacgctgcccttcgagggctcgctgggcttcccaggcggcacttttaccaaccaactccttcagttctgagagggagcctcctcgcctcggctctcgcgcagagcccagtcactctaacaagtggacctgggtgcttggggtgaggatgggaggctcggtctaaaaagaaagaaaggggcgcttctctggcatccctcccaccctggagcgttcgcctggggctctgccactggggtccaggtcctgctgtctccgcagagaatatgcccaagggctaggacgcactttagtacctgtttgcttctgaatttctatttgagcctcactcagggagcccgggttcccgggggaactgcaggacctcctaacctacgccgccgtcgagggccccacccgatgcgtcctccctatacctttgtcaatctttgtcaaaagagatagtcattacaacccaggcggtgctccaggagccgtcggtgttgactttaaccatgcgctccaatgtgcgggtttgtgtgtttccgcatttcatccagagacttggtccccgagattcagcaacggccagcatatctgcgagcgccaagcacccgctaggcaggcttggggaaatgtaacctcactttcttccactccataacaggaggattgccaatttagtttcaggatgctttgcctagaggcggagaaggggagattgttagcgctacttggtgagtggatgtgtttgcagtcaggagtgtatttaaacatttcagtgaacccgatgcagtcagttgtttacaattgcggagacagaggatctcactccactagtagatgtttccacgtctgtgtcgccactgggagagtaggggcgggggcgggggctggtttgcagctcgtactcgccgtcggcagcttcgggttgagcagatctgcatcactgctactggcgatatgctaataggggtagaaaagctctacatctccaatatgaagcaattggtcagtaaacgtcctgaacttaaccgttgttttcctgggataccaacctggaggtgtttttgaggtggcccaaagaaatacaaagagaagttctcagtgctacagaaaggaaattagtagccatttggttttaaagaccaaaaggaaacgaaacatcccagtgcactctaataggtactgttagattagcgtttaattgatcgcgtttgtgacgagtaagtgtcgcagacagcttccttgaattttagactcttgttctatgattataattaacaagccaggtaacaatgtactgtgagaatcaattgctactcttaacgtgtttgaggagaacatggcaaatgtctgctctattatattttttggctgaaatagcccagttcatcttcctagtccgaagtcttctgatctggagcagtagatactccagtgttaccaagaaagggaagagtctaagagggaaaggcttaaaaaacaaaattaatgaaaaggcgatccacacctttaacttctgctccatgattacccagcatctgcttgcttgctcacccccgctccttgctcttcatatctgcaacgtggggaaaaatgaattttcataaggcatagtaagaccctcaaagtacataactggagaaacagaatcccaattttgccattttagttcaagttcataacactattttgtgatgcattaaataatttactatggcaaagttggggtttttaagagtaattaaaagctttcaggtatgacaaaataatgttgaaaacttttcatgattaaagaaagtcgaaatatgcatttaaaaagggatcaggtaattcctaaaataaatccatgctctaaatattatttaaaagttttcaggttgttccccagaatgtttctgaaaaacaggtgtttctataaaacaactctatgaagaaatgttaacattttcataataaaactagtagagtccagtcctgagaacaatgtcagctatacatagcagaaaaaaaccccacaaatatttttgcatacatgaagtagtattttccattaggtttaggttccaattatgaattagggacagtcatgtcatttgacaaaatatacagtgaggctaaaggaaagaatgctttgtagaatcattgtgctgtaaaggtgattaagatttcaaatattcaaacgtttaggtgtattaaaataaaattgtattatacataactatcatcacattcaaaggcctaattcagtctgaataccctagaattctcagtgtttcaattcagctattatatgtgtaaataacaccgacataatcatagtttccctcatagtcattgatcctttctgatacctttaccagaaagattcttgctgaagcagaacagtctagcattcaagtttattctatacaatattactttaaattgtcaaactgcaaaacattcctgatatgttgtttctgaaaacagaaaacttagtggaaatttattttctgtgacagccttaaaaacttggaagtagtaagaaattttagtgttaattaataaaacaaacatttttcatattctatgttagagatagacatttggagtccatataatttttgcttgaagcttgcttttcctaagtcattcagtttcagatttaagtaaagctatcaagtagttggtatagattatggttaataaattccctaaagtttcccaaaacaagttaattattattatttatgcatttatttatttacttacttataaatgaccagaggtcaaaagaagaccagtactttgaataactgagtcagtgattaatttttttgatgaaaacaaattttcttatagtactcatatttgttctctctctctctctctctctctcacacacacacacacacacacacacggaagcaattgcttgtgaatgccttgaatcagatataaaacatgtacaatagctttattaaaattatatatatttgttaaattgctgtggattttaaccacaaaattaataatccatgcgtacttaaaaagcttcccatcacttaacatttagaagaaaggtttaaactggattcctagtatgactacaggcagatgaaaaatattgtaaggtacagaatttagcaattgtgaccaacagcatatacccacgactggaagtgtaactgctgattataaaaattaaaaggaatcaaatttcagaaatgctcacatataccacaatttctttaaatcttctacagcttctgagtgttagattaaatcactactttgaatggagattgctattatttttccttcccctaaaaggtaaaaatattctgaatcctggcttaatatattatttttattcctttctgttttccattgattttttttagaacagaggaaagtaaatatcaaatataaccagctagaaccatgcttagtttgagcaggtgaatgctataaaaggcttcacacagcttttaattattcttaacaaccttgatgaccaaccataggtgtctgttcagtattcggtgctctgttatggcaatttatataatgtatagagattttgtagtttgctagacgtgctgtggtacaatttagcaagaccagcaaaattgcttacatttggaacccatgaaaaatagggctgaggaaattggaatatgatggcatagactgaaaattattatataacaatatttatatcaattgcaatgctaacatttctgtatagaaattaagctaatttaaatttgaaaagtaaatatttttacaggtgacatggatccctaatattttaaaatagtaacttagagtctaataaatgaagtctattagatttttatgtaacttcaggacccatttcaaggcctggaagtataatcttggataatttacaacttaaaaaattattctaaattgtacttcctgtccgagcctccactttaggtaaacaatagcatatggtgaaacatgcatatatgccaactaaccactacctcttggatgatgtttttaatgtgatgtaatgattctgaaatattggattctccacccccgctctattctaactgtaagagtggagaagctaattggaaaatggacacataaaaacatgttaaaaatctcttttcacatgggtggataatcccctatgaagttcttacctgggagcctttatatttctgtttatggtagatatgtgccaaggttaatactttttctctgggtgcttatgacaaatttctatgactgaatctaggtgacacccaaatatgtgactgcaccattctgttaaccatccaactgtttggggtgaaaaacatctggttgtttgagaaaattgtttacctagtttctgggtgttttggagtcacttaacaggccgatgacccttaatatccatgtcaaaagagaaagaaaaaataaaataaaacactttaaaatacatgtaaaatatcttaaacactcttgggttactataaaatgcccaatgaactaaatgccatcgtgaatctacagccttctataaaatgtataaggagatgttgcttgcattctacaacaattacagaaacagaaacacactgaccttttcagcaaggcaggaaattaaaaactttaaattcaattctacaccctactcccccttccctgcccccacccctgcccactgtactgattcatcagcttaaagaaattgacttaaggggcttgatacagtggcttcttaaaatttcctgtacctcattttccactgattgtgctactgccatggaaactagatgggacagacagctgggagtcactaattcagaatgggaatctgcttgttaatttaatttcatgccagcctgttggtccctgaaagtaactgctgtaaaaggctggggaattgaatttgctagaaataaatgattaagctgaacgaaaaatcagtgccatctctgtcattttcctgaaaatcttcctacaaccctctttgtccctactcaagcaatttttaaaaaataatcacagaaagagaagtttgatttgtgcattcctattggtatgtatgtattctatggagcattttttgttctaatagaacattcacagctgtaaaatagtttcataatagctattacattgaaaaaatatgttctttcaaattatgattttgtagactttgaagaagcctagttagtgatgataggaaaacataatataaatgatgcttgaattttccagtagaattggttatttttccttttcaaataaaaaaagtcttattacaatatctatgtcccacttttattacagagaccaaatgcatttgaatacatttatttgaaatttgtaaaacagtcattttaccagtcaccagaaagcatactggttgttttaattttattcgactaagttgtaaattaataagtagtcaacaatgaggaaattgccttttaatgtttctcatattctgttgtaatgtttttgtggctgattatgagttatgaaattaaattttggaatcacaatctctatgatgagctgaattgcaatccatgtcaagtcttttgcaataccggctaaagtcctgagaaactaatattacttttctgtcaatttgtagctgtaagcaaatttctgtattacgactgagagaagatctttgataatgaaacaaagaatggaaagataaatatatgtaaaggtcagaaggtatttttctgttttaaagttaataaaatttcaaaatatatatgttcaaggtagaactattaatgatagaatgaagcagttattcaaaagtttaggaaaattaatatccacatttttacagtttagggaatactgagaatatcagtatccagttgttgagtgttgaattacgtgtattttattctttggtgtattttttgttacttggactatatctgtgtgatactaaaatctgactaaaacttaaaaaaattgggacaattatcacggaacttgtagaattcataatattggtatcttctttgtcatgtcgatttcctctaacctttcagcagatgcttgcatttggatgaacaatggaaaaagtcattcattcatctggatggttccagcttccactgtttactcaaatcctcagtttttatggttctatagcctcggtttcccttttgaaatcaccatatatttatttttcaattgtttttctatttagttgaaaggtgttgtaagtattcaggatgctgatgcatattatacatatatatgtaactttcaatagaatttctatgcatttatattaaaggaaatccactttcattttaatgttttaaggtttggaatcgacttagtgtttttagttgcctgtatgaatgatggtttttaaacagccaaaataaaagtacgtggctatcagtttgcatacttctgggaaaatctgatcactggctaaggtcaaagagaaaatttcccagttgcatggttttgcataattggtggattctaagtgtgtatattacctctaatgtctctatctggtttagacacctgtcaaagagaaggtgccagattagatggacaattggtttattagatattgcaatccctatgccccagctgcatacagacattttaagaaaactcttcagttgttcagagaaattagaaagagatactgcagatggcttatctcaataatccaggtttttttcaggtacatttaaaattaaatgtcctaagagatgattaattcaggaaagttattgataatgaactaatcttatgctacacatcctttgcacctatgatgataccttattaaaggtgtttcaatcttgctaattaccacctgtgtttaaatatagaggtgtataaatacactataactacacagtggctggaagccttctcaacctaaaattttggtactgtttttagcttactcaattcctatcaacaaaaagtttgtggtcaacattttgaatttaaactctgtgccttatccccctcctgcctttaacattaatgattttctttttttaagctgctctgcttaattgtaagcatttgagtgatactgatgtgtgatctgttctattaagtagcccaaaaatgtgtttgtgtttatgtgtgtggggctgacactttttaaatgaatatttatgaaaacatacatacattgtggacaaggatttcataagcatcatttacagacacatgaatacatcacttatttgcttactttatacttcaaatgaatatgtttttgtgactgtgactcatacgcttaaagctttaagcaatgtaagaaagcatttcagaattgtgaagcaagtcaaaaaaaaaagaaacttttttggggaagatagtattaatttcactaatgagatctagtgaccgctaagggagaagaacagtacagttgattggccaattaatacttattgcttagacttgagaataatcttacattttaaattatcaataaaatcactctaattccttccttccttccttccttccttccttccttccttccttcgttccttcttttcttccttccctccttccttctttttttcttctctttttaaactacttttaaggtttgggttggtatacagttttaagagaaaggaaataggctttaggacactcactaaaatattgggagcgattactctttttattcttcttctgattctggccaattctttatatatgttccagataattataaacataatatgagatattattatttatatttttttcagttcgtaccttctttcagttatcttgggtaggggctataatgtcacactgctttactgggttggtatttattatagatgtactctgttcatgtattcatatgctgctagtacatttgtgatatatctttcctgtttagtctaataaaatcgcaacacttaggtgtgacaccatttatttttggtttagaattcatgaagtgtcaacataaggatgctacattttcttcattgttttgttcttttcactatttgagatattgctttgatgaaacatcggacaacttgtgaaagtgaggtaattttaatgtaaacaattagagttcagtgcaagggaagtattttaactggtaatttaacatggaagagagaaagttttaacaatttacttctgtaaaacatggaataaagtatccttaagaaaatgtgtaaaacagcagtagacatagtgagagaacactggtcccagatatttagcaaaatacttggaactgctttactattgaaagggaaaaaaattaacatttacactgatgatctgtgacaatgggtcttgaaggctcctgttttccacagaggctctccaggtctcatgcactggtctctccttttactgaaaacttcagtttacatacttttggttatatatcacagaacaattttcatgaaggaaaattttcatttgctcattcttccattcattcatttgctaatttatcaaaccttcttcaaagcctctgtttacctggtgctacagagacattaaaaaatcatctttgggagacagatatataagcatactccggtcatataacaaatgctatagtagaggaataattagaatgctctggaaactcaaagattgatatagttttataaatagtcagttatttgaattgattcttaaagagtgtctaggatgttttttagtcagagaatatggagaatcacattccacatgaccttagggctgtgaaagaacactaggttaaattagcaatggggaataccaatctaggacaagagagtgccattttatttcctatccgagcctggggaacagaggtcagggataacgtcttatttccatttatgtgtctgacatacagaagaggcttagtacacatttgttgaatgaatgaatgggttggtattttgctgcatggagataatcctagaaaatggtgtttttcctgaggtttatccaaaattaagcagtgtgctatgttgtagtagtgtcaactgaacgagataaggggttttaaagtgagggcaaggtgaatcaaccttgtgttagaaagacatcaccagtatggaggaaggattgaagtagattaggagtatagtagcagtgagaccaataaagaggcagtactgcaactgtgaccaattatgaggacatgaaccaaggcagtgacagtaacatggagaggagtggacaaatttgagaagcactgataaggtagaatcaatgattctcggaaattgatttaatttagggtgtgaggaagaaggagggagtgactctgaggcttttgtcttgggaaactaggtaatgccatgaagcagaatagggaacacagaagaaaaagttggtttcagtggggataatgcagtcaggtttggacttattcgatgtgagacaccagctagatatccagatggagatggattgtgccagatggaaattacagatctggctgggcgcactggttcctgcctgtaatcctagcagcttaggaggccaaggaaggaggattacttgagcacaggagttccagacaagcttgggcaacatagtgagaccccatctcttttttaaaaaaaaaattaactgggcgtggtggtacatctctttagtcccagctactcagcactctgaggtgggaggattgcttgcttgtgcctgggatgttgagactgcaagtgagccatgattgcaccatggcactccagtctaaatgacagagcaagagcttgttctaaaaaaatacagatctgaagataaagtctagaattagagatctgggtgtcatcaatcaacatagtagttgaaatcgtaggggcaggtaggtgagcttagctagagagtatatacagtcatcttttgatatctgtggggaccaggttacagtaccccccaccatagataccaaaatccacaggtagtcaagttcatgatataaaatggtataatatttgcatatgacctaagtatatactttaagtcatctctagattacttaacaatacctaatacaccggacgcaagggtgtacatgcctattgtccgaactacttgggaggctgaggcaggaggatcctttggtcccgtgagtttgagtccagcctgggcaacatagcaagaccccatctctaaaaaagaaaatctaatacaatacctacacatcactttattcacatggattcaacaaagtacttgctgtgcagcaaattcaagttttgcttttgggaactttgtggaattattttccaaatatttttgattcacgtttgattacatctacagatgtggaactcatggatacagaaagttgactgtatagagtaaaaagagaagcaaagatgaaatattgagaaacactgcatttaagagtttagtgaaataagaggagccttcaagagagaggaagttagaataagatcagagaggtacaagccatacaagataacaagaaaatagaagctaagggaggaaataattttataaatgccatttgggcaaagacatgaaaaaataattcacaagagaggaaatagaaatgggaaatggaaaaaaaataactgaaaaaaacctcaaccttcagtaatcaacataaatgatattcagtgaatataaagtttctcttatgcaaggcaaataagttctagagatcttttgtccaacatagtgccttaaataacaatactgtattgtacacttacaattttaagagggtagatctcatgttaaatgttcttaccacaatttgtatgtacatgtatacatacaaattagaaacaataaatgcctgtttattttaaaaattaaaataatgctcagtgcaatttttcaagtcccaaatgttagtcattcttgatttctcttttttaacacctgacacccaaccaattaacaaatgctgactctaccttcaaactatattctttatctgaataattttcttctcattcattactaacactctagaacaaaccaccatcatttcttacctggaatactgaaacagccttctaattgatatccctagatccatctttgttctcatatagtttttcacacggcaaccaggatgatcattttaaaacttaaacaagatcttatgatctgtctgctctctggcttccaaaggttgacttctcaccacactttaaaaaacttgaaaaatttaaaaaatctttacaatgccctacaaggctttacatgatttggtcactatttattggacttcatgtcttgctatgtcccccctcaaacattgctcataaccttctagccatattgccctttgatttgttctttaaacatgccatgcattctttttttttctcagggccttgtgcctgcttttttatctgtctaaaatgatttttctccaaggtttctgcagactttacttttgttttaaaataaagaacagaagtttattttctcacagttttggaggctgggaagtccaagattaaggcactgacattcagtgcgggaggcagttactccttctgcttccaagatgctgccttcttgctgtgtcctccagagggaagtaccctgtgtccttacatggtggaagttgaaagggccaaaaaacaaaacaaaaaaaaacaaaaaaaaaacctagcttattccctggacctcttttataaattaccaatccattcatgtcttcatcacttcccaaaaggtcctgcctcttaatacggttgcattgggcattaagtttaaacatgaatattggaggggacataaacaatcaaataatagaagtatatgatagatcctttttgactctttcaggatcacaccaccataataatgtcaccagaaaaggtgaatggaatattctagcattacaagtaataataaaaactaacacatatggaatgcttcctaggcaaagcactgtcctaaggactttatatgtattaacccatttaattttcattcagacctctccaggtttactttcttacttcattcagatatttgatcaaatgttccttcatcatagtggcctactctgaccatcctatgtaatgaactttattgtctttcattttctatgcctttatcagcttctatttttctttatattactcatcattaactggtatcatactgtatttttatcttatccacttttctagaatattagttccttgagggcatgaattttgtttcttttttgctcactactatatccatatcacctagcacagtgcctgatacatagtaggtgattaataaatattggttgagtaaatgaatgactaataaggacatgatgaaatattagttggtgtagatttggcagtttgctgcaaaagccttaataatgttcataccaataattctacttctgggactttgtcctaaataaataatatgaaataaagaaaaaacttcatttcagatattttcaccaagcattatttgtgataatagaaaatatgaaggaacccaaatgttcaacaaggcaaatgctatgtgatttatgatatatctagacaaggcaatacataatggccattaaaaaaagatgtttacaaatattttaagataaaaggaaaatgtttatgttatactaccaaatgataaaccaaggtgtaaaattatatgtatccaatatgtaagaaagaaaaaagacttgaaaaagatatgcaaaagtgctaaaaatgattatttctgattgaaaaaggtgggtaataggtcattttttcctttattatctgtattttccaaattttctgtaattagactatataactatcagacaccgtgtatttacaaaacaaaaccattaaaaaaacaaaaaaataaatattgccatatgagaagtgaggtttgggaacaaataaacaaagataataaacccatttttcttgagagatgttgctggagggagaggaatatgccagttttagccaagaccaactattctctgactttattttgaagaggactacagaagggaaaataatcgagatccactgatccaatctggtcttcactcactagagaaccaaagagggcggaacttaccctgctaggatttgaacaggatgttcaagggaaattgcacaaattaagtcttgttcatattgctgtggaaagcactagcaatttgcttcatgtaaaacagaagtgattactcactatatttcttcatgtcatgtagtaaaaacaattaaatgaagttagactatagattacttggctattcagccacagtcacctctaatggaaaagaagaaaaatagcattgacaagttttggcaggtctcatcattagaaatgcctatattgccagaaagaaaagaagcttcagccaataatgtaaaccgagaagttctctaggccttgaggaagaaagtgacaatacagagtgttgcagcattaattgtctgagagcactgatcattgtaatgggaaaactgtctcttttattaacacgattattttctgcgaagtctttgagtaaacgtcccattaaaaaaattgcattaggagtttcaaagcatatatagcgatgtaaagatatactcattaataagataaagtgtgacctatatgccgcccaaagtcccttgaaaatagaaatagcattaatataggtattaaaattacagtataatcaggtaattatttttaaaaagtaaaaatttgtaccattttctaaactaacagaaatcatacttttaacatctatttgagaaagatatctatccatacacatgtatgcatattcacattatgtgcatattcatatatacatatattatttgatgtcaacatcttgaacccggcttttaggcccttcttctgctcacctccaatttatgtattttacctccatagccaatctctgctgaccgttttgttataagaggctgagaactgaaggaagtagaatattattatctatgtaggaagaaacaacaggcagtggtgctaattaaggtctgggctagatgatctcttaatgagctgtccaggtttggacatagggctctgcttgcagggtctagcctatctccaaaaccaatagtcagtcctgtgagatgtatttgtaacctttgtttaatagcttctgctgtttttgcctctggtatgcattatttggctgagttcagtgatggtcctgtcaaacattctaatttctttttcttaaacggtagttagcccacattcagtattaagacagtgaacagtttattttttggaaatgaattcttgagtggaatagagagataaagggtgagggaagttgtacatgttgggaattgttcagtgatggcaagtaacctgtggtatctgacatagatcaatgtattaactggccttctctagtcataaatggggtgacacactcctaaaggaaccagcttgaaaacaatggagaagtgagcagagaagagccctttgtttttccccagtcttctgtttatctcaccaaggcaaaatgctacatatagggcagtttattttttaaagcattttttgctagcctccttgcagaatcagcctgatgtatatgaagccaatttctacagacttgctctggtatatgcagcacaagagccagaaatattttttgtagtctggatctaagtactttctgaaatgtcttcccttgaaagattctaacttagcactattctggaaccacatgaacatctgagcagaactacgtcttttttgagcaacattaacagtgatgaaaaatgcacatcaggcagttagattgcaactaatcaagagcaccacttcagcctagtatgaatgatttatatatagtgcattggatatggagatcattagtaataatatgataccctgttgtcattataaggtcaccttggtgatctttgtaagatatttgtaaggtgacaatgatgttactgaactacattttaaatatggcatttaagtattgtcttctgtcttgatttactggtaaaaattttaaattgtttactcttactactgagatttttcctcaaatataaaaataataggtttggggattacttcattaataaattgggaccataaggttaattaagtgccagtcataaaatattggaatgttaaattttgaagtttcttttttcttctgctttaatttacacactgccttttcttttcttttcttttctttcctttgttatttttttagagaaagtctcgctctgtcatccagcctggagtgcataacactccagctcactgcagcctcaacctcacagctcactgcagcctcactgcagcctcaaccttccaggctcaaatgaccctcccacctcagcctccaaagtagcagagactacaggcacacagcacaatgcctggctaatatttttatttttattgtagagacaggctttcattctgttgcccaggctggtctcgaacttctgtactcaaacgatcctctcaccttggcctcccaaaatgctcggattacaggtgtgagccaccctgtgtggcccacactgccttttctaaaatggatttttgaagaattaaaaacatattataactttctatatatgagtaatatatgtttattataggaaagttagaaaatacagatacacagaaagaagaaaatcatataatttacatacatctatatctaagctcaactcacattgtggttactttataatgtgcttatttaaataaatatttttgaacatctttctatgtgaataaaatatatcagatatgtgcatacacacagacatatataaatacgtacacacacataaacacacagacctacacacagaaagagagagagagacagagacaaagagaaacagagttgaaagaaaacaccaaaaaatgaaaagaaaaatgtgtagtcccctttcccccatctcttccagaatgtcacttagaagcagcaaattaaagatatacatagaaattatatgaagtgatcattaacatctaacagttcccatattatgtttaatggctgcttagtaatccatcacataaataaatccttgatttatttaaccagactccaattattggatatttaggaaatttccaatatttattactataaaaacatcatgaaaaattcttatacatacctctctgtatatatctctgataactccttttgaaatgtttaaatgtaaaataacttgatcacaaggaggacatatttttaagggttttggtacctactgaaaagttgccctccataaatattgcaccaattttacattactaataaatgacttttttctcttttgtttttgagacagagtcttgccccgtcgcccaggctggcgtgcaacagcgcaatctcagctcactgcaacctccgcctccctgattcaagcaattctttgccttagcctcctgagtagctggggttacaggcacccaccaccatgcctggctaatttttgtctttttaatagagaccgggtttcaccatcttggccaggctggtcttgaactcctgacctcgtgatccacccgcctcagcctctcaaagcattgggattacaggcgtgagccaccacacctgccatgaatgactttttaaaagttcatatgttaaaaatccaggtgacttcatactgggtatatataaatcagaggaagaagtgtatctctcaagtggagtaaattagtagggatcattatataatagcacagctccttccttagcaccaagcatggcacatgggagactgtcttagtctattcgtcatgccataaaggaatgcctgaagctgtgtaatttataaagaaaggaggtttatttgggtcacagttctgcaggctttaaagaaacatggcaacagaatccacttctggtgaagactcaggaagcttccaatcatgtcagaaggtgaaggggagccagcatattcagagattaaatgatgagagagagagagagagagtgtgtgccaggcttttttttttttcaaccagcatttctcatgggaactaagagtgagaacttacttgcatgataagggcaccacgctattcatgaaggatctactcccatgatctaaacacctcgtaccaggccccacctccagcactaaggatcaaatctcaatatgtgacttgtggcagggcgaaaccaaccatatccaaaccatagtggagacacattttatagtcagttttatacctgttgaataaaagatgccatgtgggacgttggtaaaaggactgaaccaaaagtgaggggacatgaattctaatcctggctctgccactaaccacatatgtgagtttgaaaaagccatttaatctctctgggccttagtttcctaatcttataacagagttgtttgagaaatagatgaaatacatatatgattttttttataaattgtaaaggacaattttaatgtaagaaattaggactattataaattgtttacactagtggaaactttgaaattgtgggcatttcatctcaaaatgactggtatgttgagtgaaaattgaaaaaaaaaggaaattgaatagtgttcagttgagagagtctatgtggaatgggtgagaatttcatactcctccaggtatactcttctataattaagaaattctttgttagcagcatacttaatataatcagttgaaatttcaagtagaccttttaaaaagcggacccctttatctcttgtgaattgcacaatgaatgttcttatattcacaaccctcatctccacttccaaccctaccccacatgtatctcttccattcgttcatataaggactgctttggatttgcatgcacatatgtttgaaggataatttggcctaatttgtttacaggaattacaagggtgacctttattccgctgtctcctttttgattcccataacttctggacctatcaaggtatgtgcattttacactgaattttactttgagaattgaacacatagctacataatgtgaaaagaatggaatgttttggtgatatagtcagttgtatttattgcatgtcatgtaaatgaaatgcattgttttaaaatttttaaagtctatttgtccattttatagataagcttgtgtctgtacctcataatttttagtctttgcaaaaacaaatatgcaggctgtcttacatgtctgaataattctgtgaccttttccacatacagctactcaaatcaggagtcttcttaactaatgggaacatctgcagagtgtgtaggaacagcagtagccagagaagatgtttgcaaaactatttagtagttcttactgactacaaataaatatttctccatatcaatggaacagataattccatttagaaaattttactggcataaatatttgcctcctgaaatgaatgttttgattctttagtaaagtctcatgtaaaatatttgtatttacacaggtattgcattcatttgtttacccttccgttctaccctctcttcatctacccatctatctatctatatatgtccaataaacaggtattgagcaactttggggcaaaagttattgtgccttttttcgtggtaaatgtgccaatgtaggtataattcaaatggagctttgagagtgtttgcttctctatagtcagtccactgttaggtggactacgtgagaaaatgtggcaagatgaaggatctccctcattggttttaatttttattaaaatattggtcaatgttcagtccttagtaactaaggcacagaaagcattgattttttttccctttgctacctatatcttgcagtgctatgcatcattactcaaatgtgaattctcatttcaagctgtaaaaaagtcaaaaggatgatctgaatttgtggtaagtctttggcatcacttgatactttctttaagagtatgtaaaaaagaaatctgcaaactctcagaatttgcattgcccttctaaaaatataacacaaatatctcattaagggtttccttaattgggctccaattattggatattagtctgtatcagaaatttaaaacgtatttgtcagttttgactatacatgtagttctattagcctttctttcagaggtactgtctttaagggaatactattgccaaaaagttcagattactataggaaaaaaaatgtaagatcagaaaataaaatgacattaaaagataaacttacttaaaaagtaagtcgagattttgcatataatgtcatttgtgaaaataatttttttaatttggtaattatgagtctgccagttgtgcaatactaattgcaaagtatttttcacactaggaaagtttaaatgtgtggaaaatgttagtcttactaagctaatgtgaatgaatggatcagaatggagaggaaaatgcctgacagacccaaagaatgcacacttataaaaataattggcactaaatatttaaaagtttcagagagcagctagtttccctcttttagaaagacaacatgacatagtagaaaagcccttgtttgtcaatcaggaagcctgggctctactctcagtcttatattagtaatacgtttctcatcaggtcacttcttcactctgagcattggttttctcaagtctattataaaaactttgggctgaacaactccaactgtctttctgttcaaacattgtatgatttttagaaaattcagggctgttctcagatatgcaatacggaatcaagattagcaattaaattggaatacacacaccatttaaaagattgctccttgttaagtggtttagtgagttggtaatagtatatttttccttgatttaaagcaattgtgtattctaatgccactatcactcactcactccatgcgtactagtactggcgttataataaatagtttcaagctgaagtttagctagtagtcttgagtcttcttccttgataaaaatgcttcactttgggatgctgctgtgcttcttctctgccagtctgttggagttcagcaaactatgttttcaccttcttgcatgatggtcgttcgaggtcaagcatctctctgtaccttgaaaccatccaagtgcgtaacctgatgacttcagactccaatgctttcaatctggcacctttcatgagcattgagttcatattaaaacatttaaaatatattctccttcatctacatatcacagcagtaacaacttgggcacaagacagtgcctgagaacaaataaccacttggagttaatgatctgaggggcagctgaaggaccattgactcttcctagtcagttctttgtccctataaaatgcctacttctgaggtgccgagccttcagtaatttttctgtctcacgtcagattaagtagtgaccataaataatagcatttaatacataataatgagatgtggcaatgcaataaaatatcaacaattctagtactatattaacatggctattctgatgaaaccaaaagaatgagcagtaaatgaagttcatgaatcataatattttagaagagactttcaccttattgatttgaaatgagatataagaaagaattcatttggtttaggggagcagttccctttcttttgctctgcattccactgatgaatgatctaatttagaaataataaaaaatgcctctgacatctattttaaattgatttttaaatagtgtatgttcagctttttcccctcttttttagcagtagattcatttttcaagatatgtacagctctgaactaagttacaaatacaactctacaaatgttcttttccagaagaagcactttttatttatttattactgtgacaaacatttataagtctctacagtgtgccaggcatggtgctaggtgctggggaaacaaaaagtaatatggaacatagtccttactcataagctcatagtagagagttggggactgtgctatacacagagaaataaaataatcaagtgttgtaggtatggagtttctatgaatttacttgctcatggcatttttaaaataagtttaaaagattcatatatcaaaacctactgagtaaggcaatgatgtgtgtaatctaaaatagctctccactcaaatctgcagtaatcattggttatggtgggaaaaatgcccccccccccgcccgccgaaaagatgtctgtgtcctaatctctgaaacctgtgaatatggcatgtcatgtgaacatgacaaagaggaattaagattgcaaatggaattaaggttactaatcggctgaccttaaaatagggagattatcctggttatctctgtgggcccaatgtaactacaagcatctttaaaagtggaagaaaagaacaaaagagagaaaaacagagagatgggcccatgagaagaacttggcctgattttactggctttgaaaatggaggaaggggccatgagccaaggaaggtggatggcctctagaaagtggaaaagtcaagaacactgattctttcctagagcctccaggaaagaattcagccatgccgataccctgattttaacctatcaagacccacttcaggcttctgacccctggatctctaagataagtctgtgttgttttatgctgtcaattttgtggtaatttattacaacagcaatggcaaactagtacactgaggtttactcagtacggaaaatgtaaggagtagtctctagttgttgatcatgattactgaaaggcattcttcatgctgaaattggtgcacagggttatttacctagtgaccattttttctagatatccatatcaggtccctccatcagaactacagcgatttgtgaggtccctgaaaaacctggcaattctatcactgccactcccaatttcagagagaattcagtcctccttccctctccttctgtggaccacttgtgctccctcctcctatccccttgtcccatatccctccacattgatacctaggatacaaggtttgttgataagtgagaagtaaaaaattatctttttttctttcatgggacacccgcagcaggaagaatgatataggcactaatatcctaacaagttaccctggcatgggtttcatgacaatctaggtgttgggtattaagtagagtgtgaaattgaagtttcaagctagtggccgattgctcagggccagtcctcagatacgtttgtttgcaacccagaatgatttctctcctctcttctccttttcttcctttttaaaaatgctgtagcttgagtgtgtcctctttaattctgtagtagagggtaagtgcatatgctttggggtttaaaaccaagagaagatccaattcggccacatattgactgtacagcttgggcaagtagattaagaataatctctctaaatctcaatctcctaacctctaagatgagaataataattatacctcacagagttgtgatgttgaaaatggcatgcaaataattcataaaacaccttgcacaatgcctggcatataacatagtgtatgctcgataaatattagctattacttctgccactattcttgctatagtaagagcacaaaggatgggcaaacaatttcatctggtaggggggaatgagaagcagatatctggaaacgcttcgtggaggaggtaatgccggtaatactaggaccaggcatgtgagtgtggactgctggggaatagggaatggtaatttggtattgtcagatgaacaaatggtagggatgagaatatgttctaagcaaaagaataagtggcagagaaatatcaaataccctggtctcttagggaaactgcaatcagtctttacaggtagagggtcatgtggaatgtaagcatgagaagagataagcatagagaagtatgctggagacagatatagatggatttccttagcctgtatcctactaaggtggatctccttttttcctgtaggccagtggttttctaatgttgcttgtgaaatttgaagtttggtttattgccctctgaacctctttcttgcttaagggcaactcctgaaacagccacctaggaacactgatgattttatttacataaatatatattttttatttttatttattattatttttttagagatagggtctcactgtgttgcccacgatggtctcaactcctcaagtgatccttctgctttggcctcccaaaattgctgggattacaagcatgacccaccacacctggtggaacatggtttaaaagtcaccactcagccaagcacggtggctcacgcttgtaatcctatcactttgggaggccaaggcacgtggattacttgaggtcaggggttgaaaagcagcctggccaacatggtgaaactccgtctctactaaaaatacaaaaaaaaaaaaaatttcccggggggggggggggcacccgttattcccactaatttggggggtggggccggggaaaccctgggggccgggggggggggtttccatgggcccaaatttcacccattcaattccccccgggggaccgggccggaattctttttttaaaaaaaaaaaaaaaaaaagtcactgctctagggaaggaggaactagagaaagacgtcagtaatcatgtttgtgatatagagggcccacccaggtggtagtatggaggatggattggagggatcaaatatgaagaccaataaaccagttaggagactactgctaaaagctagataagagatgatgggggcagatggcaattaccaatggtgatagcaatgaagagacagagttgaacagtgattctcaaacttgagtatgcatcagaattacttggaaggcttgttgagaaacaaattgctggatcctacatttgagtttctgtttcagttggtctgaggtggggcccaagattttgcctctctaacaagttcccaggggatgctgatgccactggtccaggcactacactttgagaaccatgggatttgagatatgctatgtagaactgacaggcatgggtcacttattagatatgggcataagggaaaggtttctggcttgaaagcctagtcagatagtgatactattcagcattactaaaagcaagtttaggctgagttgaaaaagaaaatgttcataaccctagcaagagagggcagctaaaaatctttattattttttttttgtagagatggggtctcacttggttgcccaggctggtcttgaaattctggccccaagccgtcctcctgcctcagcctcccaaaagcaccaggattagcacctggcctttaaaaatctttaaacaagatttatgatcagatcctaggctttcttctgggcagcttgattctatacttttgtactactagcttctcttgctcccagtccacccccatttatatgccttggtgccattcacattccggaagtgaaagtacaactctgggagggggtagaataatggattccattttatacctgttgagtttggtgagccaacagaacatctaagtgagaaaacctgaaaaaataatttaggcattagtttttgtttattcgtttttaatttaaaatgaggtcatttccttatttcaggttggatattaactcttctttgtgcaaaactggagtagtcaaaatataggtcattttttttttttaggagatggggtctcacgctttcacccaggctgaagtgaatggcacaatcattgttcactgcagccttgaacacctgggttcgagcaattctcctgcttcagcctcctgagtggttgggactatatacatgagccaccatgccaggctagattgagctatcgtgcatatttcctgtcagtcctataaggatttttgagtgttaaatttgctcataggtggcaatcatcctttttatagtatagatcagtgaatccaaaacatgtttattttaaaattccccttgaacacccgtgtgacctagctttctctacgttacttccttaccaaaaaggaaaaatcaaagtatggcagaatatccatgtgggtaagtagaggaaaatagaagagtaccatacagattgacctttttcttcttttctttctttttttttgtagcttatttcagtaatggtcagatatttcactgaatctatctctctaaggttgagagtaggcaaaggaaagatcttaaaacaagataaagtacctacatgcaatggtgagatgaggaataatatagggaattttgaggagcagtagaagtgaatactaaacaaaaaggattaaattgatagacttgattttgttgcaagggggcagttgtactggtaaatcagtcattttgggcacatagtatatccttacaaatattctagcatattaaaattatcaatttacttgtcagcttgcagttccacaaagctgtagaatcatcttaatatggggagcaaaaatatgataagatggtcaattatagtcattcactgccaaaacttccttgaaaagatacacttaactgtatcattcattctcctttgaaggctgctcatcttagagactgattatgtacttgtaatttgtggataggacagccacccatacacttccatctgcaaggctcataaagaaccttaacttgtagactcaattcagtttcttgtaacatttagctccgatctttccaggaaaataagatgcattccttagtacttattcttttatgccagaaaaaaatatggaagaaaaacaactacaaaactaaaaacaaaaccttggggttttgctacgtgtttatagataagccatgatctgaaatgcatccatgtatatcaacaaaaagtccaacattggatgcttaggaaatgggatcagagttaatagaaatggctcttgtagtttcttggaaatctcactgagaagaagttattccttaggagtgttatttcagccccatgatattgctaacttgacagctgaatgcagaaatgtgtcttttgggtgaggcaaagtccagctttttcacagacctccatttcaccttaataaatttgaaatcactatttcttcagctttacatatttccaaagtatattgagaatcactatatatactttttttaaaggtaaagaaaaataaaaaacaatgacaaaaattctgaaatatgtacaaagggacaatataatcccatgccttgtggcaccatatctgaagtagcaagggtcttttctatagtatagatgttgagctggtgaccttcaaatattgtcctgttttcattcaatgtctgacatatgtcagatgaaactgttcaactcatatgactttaaatagctgttttctgtgaatgcatcagctacttattttgtcccagactcatctgtactactgcacatgaaatttaattttaaaatgtacacttcaagtgacatagttgagcatgtcactgtgtgtaatagatcactggttttgttctcgtcttatttgcaaaatgctcacctagttaaatggtatggctataatatgtaaacctttaggtgtatgatgtaaaccttcaataagttaatatcaataatacaaattttcaatgcctttcttaattttgtttaattttacacctgtgttcaaaaacaccctgattaatgctttaatattttgtatatggtgtatgaacacagaataaaagatgcacttatgtacatgcctgatccaagcttacatctacatactggaaaatgtgagtgccagctgagtaccagtttgcaccaagtttatagttttaatcataaaaaagtacatgaagttattattcatcttattgctgagcagtagtttgaaaaggcggagggagaagctctaagaaaatcctttagtaattctaagaaaggctggttttcagttaagtacatttttgtaagtcattttgtcatttggtaaacacacaatgattatgccttcagacagatgaaatatttattagaaagataaatgtggaaatcacaatagtattaaagaataccatgggagtgggaagcctgtcaagaatgttctgaccccaggaaaaagaaatcagaattgccatagagagggaccatagaatgaaaactttttaaaaggttatttccataaagtctgagaaaatcttggcctccattaagatttttgtccctgagagcctaaactgtaagtgtggtaactgctttgtctgcagaataaaaaaggaaatcttcgcttaatcattatcctgggagttgaacatcctgctaacatttgaataaaaatgcctacttcattactgatgggaacacagagttctgtgtaccaaatgatttacagtagagcttactgacagggctatcttacaaatgaatgggctttttaaagaataatacaagttgttaatgtgtatagtatcaaatgaaatatataatgcccacaaattctaaaaagtctaccaagtgagtgctggctgttagaaaaatatagtcctattatacatttaggtaaaatggaaagtgatgacatagaaaacagaattctgatgtgttgacaataccatcagtgtttttcctctagtaaaatctcttacaatgatggaaaacagaactatgaaataaccaagctgcagaggaccttgagaaatcatttgccctaggcttttgctttcaaatatgtgaatgtctacacaaagggtaagcaagtaatgtcgttagcgctatgaataccaaatcctttatttagcaaatatatacagcatttaactatgaataccaaattctttatttagcaaatatatacagcatttaactctgtgccaggcactgtgctaagcactctacaatagtaactggacacatttgtcatggtattgcttttttccctcttctacccctttttcgcctccccttattttttctctacacatcttttcctgtttcctttttctgctatgtggccctccttagtattgttccagacttcttggggtcctccagtataatgaggttactgaactctagtgtaagccctttattctcattgcttttgagaatgtcatggaattcatgtcaaatttgttatagaaatcaaagtagattattttatcattttgctttcatctctatgacttgtcattttatgatagaaataagtgttctcgaataatttggtatccacatagcatgcactgatagttacttccggtgtcataatatcacttatttaataataatattttttggataagactaaaattttaaagaggactgtgtatggaatatttttaaaataatactttctcatattaaatttccagtttgccaaaccacatgagaatcttctcttctgcctcattcctgaaagggtgaatatgctttcttcattttgtattttctcatctcattcttgagtttgtgttttttaatcttataaacttagtaggtctttagcaaaaactgctaaccttgctctttccacttatctcttgaggacatagataatcttaggtgactgacatagttgttattttaaattatagtagacagttcagttttcaagccactctcttccttatgtagacttctctgtgtgttgctcattgacttgtgtgtgcgcatgtgtatgatctagcaagttacgagcaattactgtgtgccaagtactacgctattcattttaaagtgttatctcatttaatttccacaataactttatgaaggttgcacagttatcatctccaatttgcaagtttagaacactgaggccaagggcagttaaagtaatttgagtaacgttacacagtaggtaagtggtaaggcaagtattcagggtattcagctactattcccttgagtcttcatttgttactaactgttaacagcataattctggtttctttaaatctgatctgttttctcttgtttagacatttaggacttcttaagttgaggtgtctgaatcttggattgggcctttagatatggcagatgaattttagactcctgctcaaagaatgtttttattgtggaatacctcaactaaaggattctaatgtgaccccactaaaacatgagtctggtagatatattttgcagtagaaagggccacaatatagtgaatcagtttaactccattttctgatatgccctaatcctttgcttacccatatcaccattccaagatgaaccaatttctctttgtctgatatcagtgctgtttacttcccatgaagcctccttgagtaaagaacatggacatttcttcctggcttattttctatttcttacactcaaactgtgaatgtacttgagatccattatttgtttttctccctctacctttttatccttggggatttcatctacctttataactctaactgctatttcttatataaataatttttaaaatatttcttacactatggtcccatgtctccaacctcttgccacacatgtacaattggatattctgctgatatctgaaactcattgtgtttctaacggtgagcacatcatatttccgaggttggatcccctgtccaacttcccagtttctgttgatgataccatcattcttccagctacccttgaggcttaaaaccttgaggctttcttttctttcttcttgtactttgctctccatatctaaccagtcattaggttccatcattgcttcataatgtcctttatttccatcctttattttctgtaccactgccatgagcttatctctactttagacagtttaacatcttactcattattcgccctctaaagcttagtatgtggccttgcccatagcagggattcagagtattttggttttgtgattgaggtgcaggttacctcctgcctccagcaacaatgagcacttttggaacccagcctttttgagtttatctttcttgcatgtgtgcatccatctctttggtagccagatatataccaatattcttttcaggtgtatatatttttgtcagactcagtgttatatacatgtctttcatgagctacaagagggaaggggactgaaattgatccagaattaatgagttccaatgctttaaaaggacaatcagggcattttatctagtgagggtgagacaataagctccatggcaatggagactatgtaggctttaacactgatggattcccaggacctagcactatacttagcactagtagtatttaatgaatatatgttgaatgaattaatgaataagctccaatgatagtgacaactgtgctgtcccaaaagaggagaacaaaagtctcctgacgacttgcctcattcactttaatatattaaactggggagattgcacctaatatgctgagatttttccacatggccatatatttaaggcaataattgaatctttaagaaaaatttatgttcatactaaattatatttctcgtgggataacatgacatgattctacttggacaccacaaattatattgatagggtgaaatgtgttttcatgtctgtttataaaatgtggaatattattgaattacttaaagtgttgtgtttgagatgagcttaggctggtttctttgggtttgacacatttcagtctgtcatcctgtccttagagatgttgaaaattaaatggggatacttaaataatttaatttataagcttgcttacagctatgtggtttatcaagccagatgtcggcaccctcagtttcttgcagttgagatgcttccagaatataaattaaaattggttctgcatgtcaagaattagcatgtaaaaaaggaagaaacttctttctcaaatagccaatatttgtgtagtatttgctgggcagtgccatttttttttaaccattagccaattttaagaaagagtataattcattcataaaataagcttaactatatttcggggaaaatcctattccatgtacatatgatgacgtaactcacatctttataacacaaaagtctataatagatatgttattctagtttcacgcctccctctctccagaagtcattttctgctgtttttcaaatgcagtagatttactcaagtttttatggttacaccgccaacatttccagttccttttttaaaaaattggtctagacaatattttaacaggacgtttttcctagtgagaaattatgcatctgagctcttcttcccccacataaatggaaaataaacaacagcttctatgtaatttaagcaaggctgtgggagacaacttgaggtgataggaacaatgcaggatggcccacattcaccgtgggaccttgggcaagtcaattgctctatgtgggtttgtttcttctcgtttaaaatgggggggggtgaggttgaatcatctctcagtttcattgcatgctctagaattctttgagatgttgtaaagtcttaggccacctctctttccaggttctttgcagtattaagctctttctattctttaaggcccgtgaaacattccaaggttcatgattccaacttgactttctcatttttaaaagtcctaacagcatttttatagtcagattgcagtatttagcatgtttatactgtataattatgcttgtctaattctctttatctagctctctaagtgttttcttgtccactaaaattatctttccaactggattacaagaatcttgaatacaggaactatgccttttacctctattttcttcatggaatctgttatattctaaagtaggtaaaagtatcaattgatttggattagattataatcacttatcacctgggttgaaagaacttgaagtatgaacaaagatagcctctttttatggtatattgaggcttcctgtcttagtctgtttcaactgctgtagcaaattggccataaactatatggcttataaacaatagaaatttatttctcatagttctggaggctgggaattccaacgccaaggcactggcacattcagtgtctggtgagggctgacttcttggttcataaagagccagctttctggtgacttgacagtgatgtgacttctcattgtattctcacatgctggaagaggtgagggtctctctagggcctcttttataagggcactaatcccatttatgaggactctgccctcatcacctaatcacctcctgaaggctctacctcctaatactatcacattgagtgttaggatttcaacatacgaatttagagtgggggcaggggacacaaacattcagaccatagcacctcctctgaaattatgaataatttcctctagatcccttaaattgaattaatattacaatgaaaaatactttttctgggtctttagatctcggggtataatttatgtgaagcaagtccttgtttgacaggaaggtgttactttggttattttttttttctggacctttaatatcaactttccaatctaattcagccaaaataaattgagcacacattatatgttaaaaattgtgatagactctgtggtgagttggagggaaagtggtgtgtgtaaagattgatagaaaataatttttgccctgactgcttcacagtgaggaatttgggatataatagatacaaaaaccaacaaacaaaataactcctacaatataatttaataagaacagtaatagaggtagatgtgaagtgatttggaatcacagacaagaaagcatcttactatatcttatggcttatgtctcggaatatactactcaaaggtaacaattttagaaaatgactaggaatttggttatcagaaaaggtagggaagcgcatcctagtaaatatattaaagtaaaagcacaaagacatgcaatatatctgagagattatctgatatagtatagtcagattacaggatgttcagggaaagcatttcatgagaaggtattggagtggtaataaggtttttagcttatcactgaccttcgaagtccattttattccctagagggtatacacccttgagcattttctaaatgtgaagaagcccatagggtgggagagctggtctataagaggaacttgcgcaattattttcttcctgtcgtgaaatcttcagaatcaacttcttcaactgtcctatatatttaagacagtcattttttgttcttttctcttgaatgtgtattaggaatggtgagatcgtctgaactcattttatgactaattaaaataggggaggaaacccctgaatatgcatctgaaactgaactcttacaactcacagcagtagatagcaatatagacaactgagactacattgcattcaggcttgaatacaagaagcttattcagcaaagcttggaatggagacttctctttctggtgcacttttcgagtatcagtggtggatgtctcttattcccttcaggcaaccaaggacttcacatttatcctctttctttgtgtctactcgcttctccctcaaaaacataaggcctgctctaagaaaaggaactgacgaacttagtcatttggaaccataagtgactcttaaggctcagtgggatagtctcccagtgctgtttgcattttaaggagataaaggccttgcttaacttaaatcacaagctttaaattttacagcagcacctagtccaatgagggagacatttggtatcttatcttaatgataggtactaccccaacattaatagcatgaaatcactgataacacttcatgtccttttatcgtgtccaataatattaagctatttgaagtttgataggttttgcaactgaaatgagaacctacagctagatttttataataaaaacagtataaagcatttgaatttctatgttatttcccacacttactgtttccctttatagtaatgaatagaccaagccaggcataaaaagaagaatgagaatgaaaaaaaaaaaatgaagaaatgactttctgggcctttggctctttcctatgggaccttaatttagacttctcttatatgtttctgagtttaagaaactgacttttgattgacaaggatattgttaaggttttgaatagaaacttagctattgaaagaattgtatcttagatgtgcagattagggtgggttcagggtagttagtattgagagaaaatgaagactattaaatgtatctgatggtcagatataaactagatatctcagttcctttaaaagcaaggccaaagcctgactgtgcagcaaattaagaaagaagaaaattactctgatttataccagccatgtgtggccaccatagccagtttgttagcccgttcattggaattggatttctgagttatttatttttttcatcctacattattgccatctttaaaaggaatggggtcatttttcagcttcatgcattgataagtaggtatacaactcccactgtttttcatatgtgtctaatttttgccactctcctgacaaatacgtgacaaaacagaagtcagtatattgctttttactttctcagtagtaaacagctttagcgggagttacaatataatatctagtgatcataagtagaaacaatttatttcagcttgcaaatattcctggggtatacatggctgggcactaggcactgagatagaggcaaaagcaaaagatgtggcttcttccctcaaaatgcttaccctctaggataaaaaatatgatctgcgtgcgcacacacacacacccacacacacacaggagatactggttttctgtggctgtgtaacaaaccatcacaaactaagtggcctgcaatgacaccaatttattatttcacagtttctttaagtcaaaagtctggtcatgacttagtggtttttctgctcagtctcgcaaagctgcagtcaagatgtcggttgggcttattctcatctggaaggtcaactagggaagtgtccactttcaactccctcagattattggcagaattaatttctttgtaggtgtagaattcatggcagtttgtttcttcaaagctggtaattgagaccgatagtctctgctgcttcaaatctctaattttgggagtgactttaacccccttttaaaggactctcttgattaggccaggcccacccaggatgatttctgattaagtcaaagtcatctgactggggctctaatacaaatagaaaatccttttgcctttgccatattctgttgggtagaaataagttataagttctgcccacactcatggggaaggtattacacaagggcaggacttagtgagtgtcatactagaatgtgtttgccacacacagaaaacactaaatacaagcaatgacaatacaagtaccttggtatggacaacaagtctaaatggaaagtatgtacagggactgaggaaacacagagcaaaagggtgatctctgcatttatccagcaagtttactatgcactagccatgtaccaggacctgtgctaagctctgaggctgaaataagtgcaaaatggcaagtgccctaggtaactcttgaaaacatacaatgcacaattccagaagacttcagaaccctattaaatactgttatctgagaaagagacactaaagacacagatgatgataaatatgtttactcatagctatgagttccttatatcttgctgtggaggtacaatatgacaaacacacagacagacacacacacacatacacacacacaagcatgtctacaaagcagtataagtaggtttgactgaatataacaatttccaaatatatcccttgacacaaaatcatgattgctttattctggcctctttacttactttgtgtggaaggtggaaaattgtaataatcatggccagggtttggaggtctgactcttcagtctattcaattagtgcatgtagatagcaaagcagcttctcagtttagtcgttgcattacatatcacttaatgtttgctttaatctttttctatttattaccttattggatctgaacaccagctctatcacacacacacacagcaaaatttaccgtgcccactttatagagggatttcttgtccagatttagataagcaggatactgaaaaacatgggcgaaaccctaggtcttctcacaccaaatccagagttttctatgccatgtttatgaattaacaagaaggaagtgaggtggaggaaaaaaataatatagaaaacaaattatccagcttcactagttctaccacatataagcttgaccctctcattctgtgtttggtggatcctttgtccattgttcatttttaagccccaaatcatgtaggctagagttctttatgaagccagagtatttatactcaagagtttatgaaaagttgttgtccctaaaatgtaccctcagactcacctagagggaccacttccagtgaataggttcttcgtgccccattagtttcttgatttctctactgagagtgcaaacaagcttcctgttttcacaatgattgtaatgatgtgaacatttacccattgggaatgagactgaaatcaccaaatcatttcatatgggctattgcacaattgacagttatgataataaatgtcaggacactgctgactgcttgttcaaatctactttgggactttttagttcatccagttttcctccagattttatgttctttctattattcaggctacttcaggccaaatatttagtcagtttttcattttgtagccttactgtctgcatccgggttttacatagtatattgaagagactgcttggtcacctaaagctgctccattttgtcattgggaaagcatgtcaggcaataaatcctgaaaagaatgaacgtttgctttatataggtatctcataatccaattgcaaagtctctctcaggaatccactgcaatttttgttttctgcaggtgaaattcaatgagataacaacagtgccatatatgaagccataaaccaaactccttataaggatttgattaagaggaagaaggaatttatggttccaggcttttagataccacctaatatgcaattttatctgtcttcaattattcataagtcatttcacagacacattaagatataccagtcttcacatccaaatatttttggtagcatgtttttccaaaaatctccttgtaagattaaatttaaaatttgagcctcagtattcaatatggtctagcacaaacatcctgagtatctcactttacacttaaatttattagactaagaaactgggtccttaaatgttagctgctggctttattattaactagcagtgtggcggtgaaaaagtcatcacaacctctccaggactctattttccagtttattgcccaaggcacttgtgaaaaaatcaagatagtgtacatagaaaaactttatagaaaatggagaacaatggacagaggagttattattagtaataataatggttggtaagttggatgaggttgctatttaaattcactatatgcttaaattttgtaaatgatcattttctagtgtgaacacagcattcttaaaattgtttcctttgaacttacatgttgttttctaagaaggttatgatgttttaaagttatcaagtgtaaatgaaaagagccaatgcatatatttaatattgtttttacttaaagcagtgtatataattagtgtctactccctaacgagtagggtgtaaaaaatgaggtacagatattaatttgttctgcttgctatactacattatatattcgtatgcatttttaaaacatgctttagctcaatatataccacatttgcaaaactcaagtgtcatcagcatcaaatcatttgaattattttttactaacattattttctctttaatggcaagaatcgcggctgtttaaagcacccagaaagtaactcaggccaaccatgatggcttgaaaatgtgactaatttattagtcatgcagtgataaactatatagtgaacagggagaagacaaaatgttttccaaaagaaatatccatgtaattttcaccacctgagttctccactgaagcaaggttaagaagttagcataatgttcttcctgaactgtgggccctgtgccaccaggctttcagaagttgagcagaaaagcagctcagcttttgtcttcccactgtcattaaaagcatctctgcttctctttcccttacctgtatccatgggagtctcaccacatcaaggaacattacctgtcattgtgatgcatttaagatgcaggtgtctgaatttttctttttccacttttttatttcatgcagtgtagtaatttaggcttcctatggagaggacatcttataaatgaaataatgtctcagatctgcatatacatgtgtctgtattagtgtttaatggttttgttttgaatcaggggtatagtggctattaatagagccagagaatatggcaaaaatccaactttctacacatttatgtttaatatgcaaaaccaattgttttccactccgttctttcctgctttctcctcctgtgtcgtttccatcctcataatggtgttaagaattggtataattttgttaactagaggctatgcaaattaatagagaaggtttattttgatggtctagataatgtgaaggagaatcactttctcactgtaaactaatctgtaatgacagacactcaatgtcaattgtgtcactgacagctttttatgccagctttagcaacctttgtccttctggatgttttctagtcatgaacatgatattcagtaatgaacacctttttggtagaagttgaatggaggtgatggctggtattggatgtaagccatattccttttccagaaacttaccgtactcaggaccaatacatattgactctgctctggtatgtcttcagtaatagaacagtgcttacaacgatggcatacttatacaaattaatgagtcagtagagaattaaagacacagaggaaaagaacttttccctgttatttactcaatgaagtataatttggaatgttgcgattatgccttaggtgcattcttagtccgatgaaaaaagtcaatgaggcaagttttacaagtattcataaactgtctactatgtgctaggttctttgctaggtgctctgccaggtgcaaagcaataattttgacatttcaaatgttatccttatgtgctttagacttaagtgcaatacaaattcagagaagagaaatttagtgtagcctgtattatttgttgatggctttgtagagcagttgagacactggatcttgaggaagatctacaatctggagagattaagaagagtagtgaaaatattccacttgggcagaatgacataatgaatgcctcagactttatttgataggcaagagtaaattgagaattttaagcaggtatgttccatggtcaaatagtattctgagagggattgaaagtggctggaggagggtgagggtttatcatttagaagggtattgcagttagctatatttatcaatcacttaaacaaatggtcagttcaggctttgtgtacatacatggctgaaatcagtcaagtaactagttgttttgaaattagctgacttgaaactgttgtgaaaacaaccagtttgattgaattcacttgtttctctccagatcagctcattattacataagcactatgtgttagttacactcagaaaaaaaatcacttaagcttgttgtttcatggcttataggcaaacaagcttgtagattacctaaaaatttggcttttcagttggaagtttcagtgttgtgtcgatacagccttttaagagttccatagatattggcaggcagtactaagatatgttagaattagttgttaggaaacagacttaagttatcaagagtagcaaaataagtccttatggaaagaagtgacaagacacacatagtatattttattaaatattttcagtggtttataattaatgtataaattaaaaattatattaatagaatgaagaaaggatgagaaggaaaaagtgacaaaaacactttttatatgtcattttaaaaataatccatattggaaaacatgactattgttaggaaacaggcttctctgaagagaaacagtgtgtttgttaaaaccatattccgaagagttagtatcaggctgaacattaagcagagttcatggatatttgttaaacatttattttctcggatctgaatgtcatgtcaaacttactttacctgaaggaacatgaactgctccatccttaaaaataccctggggcatctttatttttgttcctaatagccaacctaaatacaatagttatactgatttgtcttgattatttactattgatgcattctagataatcattatgatgtcattggcaatgccaagtaagttagctggtcatgacagcctgttgcaagagtggctcaccagctaatcacactgatcctaggatgagtggggcaatatgaggcaagaaaagccctttgagaaaagaaccacttctctgtggcagttcttgtccaacaaacacacactgctactattgagttctgtccagcttccagataatagctatatccattatatagcatccagagaggctagaggcagtaataccatttaagaagctgttggcacagcccaggagaaagttaatgttagcctggataaagtggtggcagcgggggcagcattggtaactctgggaagctggaatactgagagtgagaagagagagggtcagaatgactccaaggcttcaaccttgggtgactgagagtgtgggtgctattaaatgaaattgggcattcaggaagtagagtaggtttgtgatggggaaagatgttctattctggacatgtcgtctttgcagtgttcaagggggcaactgttggggttgtgagatttgggtttagaaaagagattcaagctgcagatgtagatatgggagtcatcttatcttcaaaatttagatgttaattgaagctgtggcaacagatacaattgcccatggagggaatatagagagccagcaaaacaaaacaatataaaatggattgaacaaaagacttgaggtgctggtggaggaagagtagccaatgaaaatgttagagaaatggcagaaagaagaatgagaatcaggacaatttaatgtttcagaatctaaaggaacagagagaatcaagagatgtggaggtggtcagcaccatcagatattgcagaaaagctgaataggctgaaaattgaaaaaaagcacctggatttggcacattggtgaacttcatttaaagagaaatttcagtgtagtagaaagagcacatatcatattgcagtgagtgagttactgaggaagtagaagagatacattctgtgtcacacatcatcagtgatagaagctatagtgataaagtaaaaagaaatgggaaaattgtcttagctttatggattttaattctgagagtgctcaaatgcttcattaggtggcatccccattccatatgcttatccaccatgaatccagtctaactcttccatctacagtatctagagtagtttgcccctcataatattaacatagctgaagcagcttcaggcatgacaacctcatacaacaatgcagaaaggggcagaaaaaaaacctagttgattcttgttactttttaagtgctaagaaatctttctcacctctttaccgcaaggagccttcctctcatatctcattggacagaattaggtcacatcactcttccttagccaatcactggcaaaagaacacgtaattaccataatccacctatactaatcaagattaacactctgtgattgagtcaggatctggagatgcagctttagctgggacctgggtctgggtctgggtctggaactagactttctttattcaaattagctttattgaaatacaattcacataaaataaaactcacccatttaaagtataaaattcaatggctttttatctattcacagagttgtgcatccatcaccaaagtcaaatttagaacagttttattgcccctaaaggaaatcccatatccattaaacagtcactctccattttcccttccccaatccctggcaaacactagtgtactttttgtctctatggattttcccagtctggatatttcatataaatggaatcatacaatatgtgggttttgatgattggattctttcattaagcataatgttttcaaggttcatccacattgtagcaggtatcaacacttcattccttttatggctgagcagtcagccctctatgtgttctgcatttgtggattcaaccaactgtggattgataatattagaaaaaaaacagtaaaaatacaacaataaaaataatttgaattaaaaactaatacagtataaaactatttctataacgtttacattatattaggtattataagtaatctagagatgatttaaagtgtaccagaggatgtgtgtaggatacatgcaaatactatgtcattttagataagtgacttgagaatgctcagattttggtgtttgaagcagtcctggaaccaaccctgaggatatcaagggataaccatatataatattccattgtatggatacagatattttgtttgcctatttattagttgttgggcatttgggttttgttttttttttttttttttttttactttttggccattgtcgaaaggccaaagcaatattcattgctatgaatatttatgtacaagtatgtgtataaacatgttttcagttttttggggtatatacctaggaacagaattgctgggtcatcagttagctctatgattaacattttgtggaactgacaaactgttttccacagtgattgaacaattttgcattcccatcaacaatttaagagtgtcccatcccaatttctctacatcctctataacagttgttatcttttttaatagctattatagtgagtgtgaagtagtatgttataatggatttgtagtctttcttgaagcatatagataagtggaggagcgaggatatctgaacaaatctgggatgattttaagacaatgccatagaactgttgtgtggcgtccatgagcatttgtgggctattgtacccaatttcttttctttctctctctctctctctgtttttttttttttttttttttttttgagacggggtcttgctctgtcgcccaggctagagtgcagtggcacaatcttggctcactgcaacctccgcctaccgggttcaagcaattctcctacctcaacaattctcctgcctcagcctctcaagtagctcggattacaggcatgcgctaccacgcccagctaattttttttttttttttcagtagagatggggtttcaccatgttggtcaggctggtctcaaactcctgacctcaagtgatccacctgcctcagcctcccaaagtactgggattacaggcatgagccaccatgcctagctttctttttctttttcttttttcttttttttttttttcattgatggtggagtctcaccctgtcccccaagttagagtgcagtagtggtgatctcagctcactacaatctctgcctcccaggttcaagcaattctcctgcctcagcctcccgagtagctgggattacaagcgcctgccaccacgcctggctaagttttggatttttagtagagacagggtttcacaatattgaccaggctagtcttgaactcctgacctcaagtgatctgccggcctccacctcccaaagcgctaggattacaggcgtgagccaccatgccctgcctccaatttcttttttgactgaactgtttcctactggttagttgtgcctcctttgggtctcaaaatctcacctcttcatgtgctcatgcactgctctgtctttaatctcctatgtagcctggatctctagaagctgactctaacattctttatttaaagaaagaagtgagaattaactattatagaccaataacagagtctggtcacaaataaatacaaaaaatgttcttatttaacttaatttggtaacttttttggatttacttcaactttacatttgatacattatttgaattatcaaaattttcaggtactgactcaggaaagattcagcataataggcaagcatatttggatctaataataaattatataattgaaatatggtataaaaatataactcttaaaattcatctgggctgatctattggttactgtgatagatgatatagatgttacaatagctgattggtgttataacaccagttcttagaggaccatatatttgtcaggctcatttacctcaaaagcaggagttaggtttggtgaagcatggcaaagagtaaatttttagaaacataatcatgggcataagaagtcttactcaggagatgggtgtgcgggtcctgtaaatccttaggccaacactaaattcagtctgagcgttccaagggagctagcatgaggatacgttaaggggcttaaaaccaaaagtgagagtctacagcttttttcttgtgattagcaatcatacacccatagagctgctgtgtggacctccatgaccatttgtgggctatagtacccaatttcttttttgactggactgtttactactggttagttgtacctcttttgtgtctcagaatctcacctcttcatgtgctgctagactgtttctgcctttactctgctatacagcttggatctctggaagctgactctaaccttctttaagtaagcacttgtttttttttttgttatcagacactgctatttgcctagccaaccaccatttcctctttcttcattgtcaatattatgttggatgtttttcaggtatcttaaaattctagattcataaacatattttattttataaatgaaaaggaacttagaagccatttagtcagtgtcttaaaactgtgggtgggcaatttgcctactaataccacatgggtccttgctctctcttgggaatctattaaatcagcatctccgggagtggaacccaaacactggtattttgcaggctcccaagagtagttaaaatgtgcatctagttagtactagtataccatcccaaaaattactttgagggacatgaatgttaatgttataaaaggctatgctttggtacaaccctaaatttttctgattgatatcatgtggataaccatgaccctgtatctctgctccagaatgctccttgatacttctataaagaccaccttgactaggaaggaccatgattgactcagtttgacattttgctttttttttttttttttttttttgagatggattcttgctctgtcaccaggctggactgcagtggcatgatcttggctcactgcaacctccacctcccaggttcaagggattctcctgccccagcctcccgagtagctgggactacaggcatgcaccaccatgcccagctaatttttttatttttagtagagacggggtttcaccatgttggccaggatggtctccatctcttgacctcgtgatctgcccacctcggcctcccaaagttctgggattacaggcatgcagcactacacctggccatgtgatttaaatatatatatatttgtttattacctatgtcaggatgtaggtaagaacatatccaaaaaatattccttctccgccataaatttgatgtctctgttttcaggttagggttatgtgtattagaaagttatcctcatattagtatgatattttctatatacatttggcttgaaagacaggttttaggaatactgaagaagattgaatagtcctttttaactttaacagctagtgagtttgttcaaataatgacacttttcccctgacttagagataattgctcgggtatgtgtttaagtgaagtgttttgggaaacatacttagttatatccatgttttcttccatgaattgtactctaattaagctctgaataaaataggaatgcttttttataccttggttttgaatccattcactttaggaatgcattctaaacatgaccatcagtgctgaattcataatgcaaagttacttggaaattgaggcatgctagttcgttcccaccacatcgacttattgggagatcggccattcttggaaattgctcccagagaaaccaatcatcatcaagttttattacacatgcatagtgtatagtgctccaggatccataacagtaacaaaatatggtatcagtcgatggatacaaaagcatatgtaatgtgtaaatgtctatctgcatgcagcattgtactgagcacttaggtagtaactcggtgctgacacttgtattttcaagctatattgcatattggggtgattgacacatcaatctagttaaacagaagcagaagcagaaaactgtcccagagcttcttacaggaggcaaacaacttatgtctacatgtatgactatggaatcatcttttacgtaattaagtaaaaatgatctgctagaccagttattttcaactctggctgcatattaagatcagctagggagagttttaaaaaataaagacaaccagttctttctctcacagattctggtgcaattggtcagaatggggcccaggcatcagcatttttaaggcccccaggtgattctaatgtgcaaccaaagttgagaatcactgaacctgactatgcatcatgaggataggagccatcatttgtcttgtttactgctacactcttttgtccaggccagtgcctggcacataatacttcaataaatatttgtttcatgcaaagttaccatctctagaatcggtagagagctgaacatttagactcagttatccaggcattcaaaaaccaacatttttgtggaaagcagtttggcatttcctcaaagaacttaaaatagaactaccattcaatccagcgaactcatgattgggtatatacctaaaggaatataaatcgttctaccataaggacacatgcatgcatatgttcattgcagcactattcacaatagtaaagacatagaatcaacctagatgtccatccatgatggactggataaagaaaatgtagtatatatacactattgaatactgcacagccataaaaaaagaatgaaagcatgtcctttgcagcagtatggatacagatgaaggccattatcctaagcaaactaatgcaggaacagaaaacccaataccacatgttctcacttataagttaaagctaaacgctgaatacacatggacacagaggagaacagcagacaccaatgtctactttgggtggagggtgggaagagtgtgaggactgaaaaactacctattgggtactatgcttattaccggggtaacaaaataatctgtacagcaaacccccattacacacaatttactcatataacaaacctacacaggtacccctgaacccaaaataaaagctttttaaaaactgctaaatgtttatagcagttagaggcctgcggatggttacaaaagagatgatctcacaaaagccctcaccaggaggtcttctcaactagtggtagattatgcctgcttcttgcctaaaataccaaactgtcaaaacaaaaaaatacaggggccctgacctcaaggtgtttgtaacctacataaaactactaatttcctacttttttgtggtctccttcttgctcctactgagaggtgacagcgtgctggcagtcctcacagccctcgctcgctctcggcgcctcccttgcctgggctcccactttggcggcacctgaggagcccttcagcccgccgctgcactgtgggggccccttcctgggctggccgaggccagagccggctccctcagcttgcggggaggtttggagggagaggcatgggcgggaacccgggctgccagcagtgcttgcgggccagaacgagttccgggtgggtgtgggctcagctgccccacactcggagtggccggccgggcaatgaagggcttagcacctgggccagtggctgcggagggtgtgctgggtcccccacagtgccggcccaccggtgctgcgctcgatttctcgccaggccttagctgccttccagcggggcagggctcgggacctgcagcccgccatgcctgagcctccctccccccgcccgcctccgtgggctcctgtgcagcccgagtctccccgacgagcgccaccccctgctccacggagcccagtcccatctaccacccaagggctgaggagtgtgggcgcacggcacgggactggcaggcagctccacctgcagccccagtacgagatccactgggtgaagccagctgggctcctgagtctagtggggacttggagaacctttatgtctagctcagggattgtaaatacaccagtaggcactccgtatctagctcaaggtttgtaaacacaccaatcagcaccctgtgtctagctcagggtttgtgaatgcaccaatcgacattctgtatctagctactctggtggggccttggagaacctttgtgtggacactgtgtatctagctaatctggtggggacgtggacaacctttgtgtctagctcagggatttatttaaacgcaccaatcagcgccctgtcaaaacagaccactgggctctaccaatcagcaggatgtgggtggggccaggtaagagaataaaagcaggctgcccgagccagcagtggcaacccgcttgggtccccttccacgctgtgggagctttgttctttctcgctttgcaataaatcttgctgctgctcactctttgggtccacactgcctttatgagctgtaacactcactgcgaaggtctgcagcttcactcctgaagccagcgagaccacgaacgcaccgggaggaacgaacaactccagaaacgccgccttaagagctgtaacactcaccgcgaaagtctgcagcttcactcctgagccagcgagaccacgaacccacccagaaggaagaaactccgaacacatccgaacatcagaagaaacaaactctggacacgccgcctttaagaactgtaacactcaccgcgagggtccgtggcttcattcttgaagtcagtgagaccaagaacccaccaattccggacacactacgtccattaagaaatgtggacaaacagtactctaggtgagtctgctttttctttgaataataatattaaggggaggaaggtagatatttgttgtgtgaacagagcaacagacctctgtggaattttcaaagtagttttcaagtctgttaacacggtaaggtgtttgggttatactcttgctgtaacttccaactttgaaatctagcttactcttaattgcgtctcagaaactttgccaaacagaaaactttctaactagttttcatctcttactctttctcatgacttcgatgacttcagaatcttatcccaaaccccagggttatgactccaatttaaatatgtaaattaaaaaaatgtaatgccagtgccctttctttttagtgtatattggctccaaatgctggcatagctgggatttgataattactttgtcctatagtaaatctagttgggtagtgaatcaggtaacatttaactaattgattgtattttctttttattaattccatgtttgcaattgagttatgtatgaagcagtaaaaacatcctgctgttctttttgtaaatgatgttatattttatcacacagtgtcttaagaatactaatgcttaaaaagatgacttgaggattaaaatgcagctttagcttatgggagaaataccactcaacaatagtagatacaacatacatgtagtgaaaatgacaatcaaactggtctattaagtgcagagacagatgtcctatgtaagagatttctgtgtcattgctgggaaacgtgtgtgtgcattattcatctctgctcaggctctacattcaaatcctttccaagtattcccttttgaagtactttcatgctgaattgctgtctgtgagtttttgccttacgtttaacacccaatttgtttcctctcagaatcacagtagcaaagtaggggagaaactaagggtcaaagaatagcttaatctgaaaatcccagttttatgcagttggtataagaggactccagtaaggaagtactttatgaaagtgaaagctctacaaatgttagatgggattatttttattcaactatgtttggcattaaaataaccttagttgtgctgattattaactttctgtaattacccatcaagaaaaggaaaagaaaaagaaataactttgaattctgtttcagcagtattgcctgaggaatttaagctagtcaggtttttgtttttgtttttgttttaatccagatgattatttacgtttacatgtgtaagaggaaaagacccttttcttaaaggacttaattgctgtaaaaaggcctataattaatgcagtaagtgattttttaaaaaaatctccattttacaggtaaaagtaagtgattttggaaattgcttttgaatagaattcccctcccccaaagtcatatgtcttaaggacattctgatggttaaaactcaaggagagaattctgctggttttaccttttctacattgaaagagaacacttgttggcagtccgtaagcactagatttccttcatttagctctttcttgggggaaacaaagtttttacctcaagcttctcttgagttcctgacagattccattctccttgaaacaagcggtaactgaatattactaagacagttcctccagtgagaaaactgcagttggggaactctagccccataattgctttttcatttgggactcagcttgcttacaaagaaattggatgtttgggatttaaagacacacctccattctttgtaccatcactgatttaattgtcctgtcttcctttctttcctcccttctctcaagcaactctttcagcaagtgtgatttgaattaggcttgccatattgccctcttcaataacatcaaccagcctcttgaccatttaatccattttgaattctgaagatacttttgtgtggcaataaacttggttgtcacaagcttccttcttcccagtgtcatagtttgcagaaactatttaggaaaatctggttccttatgttcctagaactgtatggctatagctttccccttagaaatttccctatggaaggatggcttctattacacaggaatgctttctctgaatactgtgaccagagaatctaagtgcctgtgttgattttgaccaaattaacaaaatttctataattcatatcttttcgttttatgacaattaagtaatatttcatatgtgtcacttttattattttttcttttcaaccacacctgttttggtcaagtcatctcttactttcttaaactcccatacattcacatacatacacatttctttacacattcacactattttttttttttttttaaaaatacaaagtcttgctttgtcacccaggctggagttcagtggtgcaatctcactgcaacctccacctcccgggttcaacatattcttgtgcctcagcctcccgagtagctgggattacaggtgtgcaccaccatgcctggctaatttttgtgttttagtagagatgggattttgccatgttggccaggctggtctcaaactcctggctgtaagagatccaccagcttcagcctcccagagtactgggattacaggcatgagccaccgtgctcaggcctcaagatgatattctttatgaattttttccctctattttagctaaagttattatgaagtatcgatatattcactttaggccaaggtttccccacatagacactattgacatttggggctggataattctttgttgtgagggtctgtcctgtgcattgtaggatatttagcagcattcactacatgccagtcctaccccctgcccaagttgtgacaatcaaaaatgtctccagttttgacagatgtccccaaagttggggttggagagcaaaattgtccccagttgagatctactggcttagaatatctaggacctggcctttcactgaaaagatacaatcatttttcaatgtaaaccatatacacaattttcaattaatgcttgtaatactgtttgtatgtactatactcataaccttccatatacttcctattatttgaagagttacaaatagtctcacctattttccatgattgtgacatgattatatccaaataatccgtatgtctttacccaagccccttttacaagcattttctctcacaaagcaataatctataatataccacaaacagttcatctgtgtcattttttccgctggtctccgatctgttatgttatgctgacttgccattatttttaaagcagtgatgctaaactattttggataaatacctcaattgctttgtaactttcttggaaacattaaagatattttattttaatatttgggagtatttcttttctactaaggacttttagccagcattcctttgtaagatatcatgttctgatgatttatttgttaagtttaccctttcaatataaccgctgctataagctcgggatgcattatacattttcaagatctgtaggcccactggaattttgatttttttcccctgacattcacaggaatattatacagacagattttctatttaaagataactttgactttgtataaacctcactgtgccatttaagtgataaatattggtgcatgaactggtttgactttctgctgagaactgctaaaagccttttaatagaaaacaatagggaatgtcaaacattgaatcacgatctcactgaagcaatttttcttagaaagactttcatcacacagaagttttatccttgctcaaattttgccagaaattatgtctggttaaaatctattgtgatgccttgtgcagcttgtttacccaatcttttatgaataaagggcagctttttaatatgttaccagctttgctcttctctttcttttttaaaataattttcatacttaaatactaactagctttgaacttaatttttgtctaaagatatatttagggacaaaacagaagactgtaattttattttaggttaggtatcactaagagaggtggttaatggccacatgtatgtttaatggtatgtgactggttgctttgggagcaaataaactagaattcccccaaatgagccactcattttactttgtcttgtcaccagtttgtgccttctaacccaggccagctgtctcacaacagaggccacgtgaaaggaatgcaggctcggcagagtttagtcatcactgtaaaaaattgcttgaataatataaactactaggtttatttatcttagcattttcaattacaatgtgagctcagtgagttttgactaagccctacctttttcaatatattaggtctatttagaacagctaagaaggggaaatcaaaataaaaatcaaacagtaactggcttcatgtaagcgtagtctgcatgtatgaaatgtgaaaagtcccatttcacagctaaccaccattttggacttgccattatcttcctttcttccttctttttttcttcattcttttttatttctttccttcctttcatttcttgatagcagtgtttagctggtggtgatcctcattaattctcttatccttcaataactcgtggagaaatcctaaaatcccttgttttgatgccagaagcatgtgttggttactgaaacaatagtctaattaggctccaaaattagaacgttgcctgtgttggaccctagaaggggtagatactaaaaaactaacagatacacattgtggttagattgtgtgttgtattccttcattgcacactgtcatcctaattcagtgccttacatatagaaggtacttaattttattttttcttttatcagggtattcttactgttgaagtgaaaaaatggtcctgtcttcctctacttttagttttttcaatgatcgcaatatccatctcttcccagataaggataggaaatgttttatgtagcattattgtacaataccttaaatatatacttaatttaataaaacttaaaatgcattagaatttatcctctattggatggaattattttccttaataatttaatatattagttaattcatttactacctaaaaattcattaagaacgaaatatttcctataccctgtgctgagcactagggatgcaaatggatgagatgccattactatcctcaggaaagaacaatctattggaagagaagaagacacaaataactgtggtctggtgaaacaagacctatagtatagatagatacaatgtgccatggcagatagaggaagttaattctgttaatggcgatacagggtaggctgtccagaaagaagatgacacttgagctggtcttaaaaaatggagaggagtttgccagttaaaaaagtagcagtgtatattgctggaggtgataacatccattccacactgcagacagagcataagctaaggcatggaaatatttgacttgttgatatgcatgtcatatgttccagtgtggctagagcatcagtggcattgggacacttaaagtatatgatactagaaagatagacagaaccttgaatgcctattaatcaatttggattttatcctgacagcaaaggagaaccactgaagtgttttaagcaggagtttgacagtatctggtttctaatttagagagaaaattctgttagcagtattgaggatgggttggagggagaagatgtgggatattaaggaaccagttaggagtttactataattatttaggtgatggacaatgagtgcctggattaggacatgggcattgcaaatggaaatgatgacatatttcttagttatgttagacagaactttagtaaccacttgtatatggagaataaggagcaacagagaagaatgatcccaaggcttctagatccagccactacgaacaggaacacaggagaaggaggaacagctttggttaggaaaggtgatgttggaagtgtttgttgtaagattactgtaagaggttagacatttagaactatggaacttgagttcaagagagaattagagttagagacagacttgagggtcatcaccatatctgagatagttaaaagcatgaacctgagtgcaattgttcaatgaaagcatatagaataagaagagagcagagaagaaggaataactcggtgtaggggggatgggttttaagaagctggtagaaaaagagaagcagacaaagggatcaagtagttgcactacagatgtcataattggactacaggaaaaccagtgctgttgggtaactgatagaaaagaatgagcaggtatggaaggaatgagaagagagataaattaagaaagggagaaaaattgagagagaatagacttagattgaatgctgcgggaaaagagagagcaaaggagattgaaaaggagaaaggagtatgtatatacatatatacaaagagagagaatagtgagagggaatataactgatacagcaagttttcagatgaggcattacgggctagtagcgcagactgggggtaaaaaacacaggtgagaaagattcttgaaaaattaagaggacatttcttcctctgatgcgaagaaaaaggagtaagaataaatgaaaatagattttgaaggtatagttaagggaagttgagagttcaaacatgacgacttgatttctctatgaataagagaaaaagtcattggcggccatgacagtgagttggcctaagtgaagtaaggctgatactttatcagcaccagtgatagttttttgagaaccaacttgtgtaaaaaacatttataaatctgcggtgtaaccaatcagcaagataatgagggttttctcttgctcttggctgcttgtgagcagcaggaagagaaaaataaaatgaagcagggatggatgcaggattatgaattggcaggtcaggtgtggtaccaggtaagccgcgtagggacctgtgatcactagtgagggttaggtaggcatataagggaagttaggaagacactgatggactagcaactcagagacaagggatgtggttggaggtcttattgaggtttagtgggagtgaagaagtatattttgaagtctaattataaggttagagtcttgcagatttaagtagagagtctattatggcttaactaatttttataactaaaaagtaatgttgagtaaaacatgaaaagaatttttaaactcctgtgaagtgtgtaccagtgattagagctgcgacagcttataggaataagatcagaaaaactgaagctggaaatgaaatgctctgtgtgtctgtgtgtgtgtgtacaatatatccacacatatatactatagtatggtatatactatacttatgtagatatataagatatataaaatacacacatgtatacacatatgcatacatgtgtctgtgtgtatgtatataagatatgtatacacacatatatgtgatatatatacacacatatatgtgatatatatacacacatatgtgtgtatatataaataagatatatataaattagatatatatacacacacgtgtgtgtataaaaataagatatatatacacacacagacacatgtatgcatgtgtgtatatttgtatgtgtgtgtatatttcatatgtgtcttatacattttttctttcaactattttgagaaaatacaaacgtggaaaaaaatgaatctctgttaagtaaaaagccaaagattggacctgagaggtgataatggaaatttttagggactatggtcatattcttggtaggtgggctcagaattcaagattttaatatattgaagaaatggccagaaattaaccaaattttattacagcatgttttggggcattggggaggcaaaaacaaaccgtgagtaagggaagtcttgcatgttaatcctaaaccctttaatttttcttatacctcactagatatgcattctagtaacttagaatttaagtaggtcttccttattaataggagaaactgcaaatttactctacccttcactttatgtacccttaattctctctatctcagaaacatcttcatgaattgaactttatacctctattgacacacacaagtggttctaagcccagtgcctagaatatttcctagcacttaattagaaatgtagataaatacctaaataacaataaaacataatacatgctataatagagaaataaaaggaggaaatggtggtgcctgaaggaggaaatgaccaaattgtatataggtgtgttagtgacacatgtctttaatcccatggctcttaacgttgaccctcaaatccttaaaccccctccccagagtctattttccaccctggattctcccttccttatctccttttgccctcaccaaatttttccaccattttgcccaatttcacaataatctggtaaagcaactggtaccaatgagataacatattagtgtattgataagagccttctgaagggattgtttcaacccaaaggaatgacaccataaaatctcagatattatggcaaaatcatggggaacattatttactttgggtagacaggttgtctaatgactctaaagtcttatcacattggtgtttatcctacttacatgtaagactgaccttgtatttgtataaaatttatatatgttgcctagtaaaattctgttgatcatttgtgtcaattaaaaggtctctgggtataaaagttgtggtctgaagaggtgcaaagatttagttagttttactatcacggtttcctgaatcattatggcttctatgattaagaaagttttaaagcaacttgtaaagatttaactttgtcctatgccggtaaatccaaccttgatcaaactaactcaagttcccagctccaagagggcatttgttctcactgtgttttctgctcgatttcccccagctgaagtgaaatggatgaagaattttaatttgtcttttttgcattcaaatataaaaaagtcattggatgttagctgaaaacttatgaagtgacagtcttgttaataaagacaaatgagatggcttgttttattaatattaatgttgcacataatgtagctttgctaaataaatatatggttacattttgcaaactttgcaaattaagaatttatagcaattgtagattttaaggccaagttacaaattttcaggtgcattttaattgttggcaaatattttaagattggagaatcacttacatttatttgaaatatttgtgaagaaacttagcttacagccttgatgatttccagtatttgtagtgatgtcctaattatcatactacttatagcaattgagaactatggtaattgagaaggagaatcttccacaatctaatacaagtcaatcccactaatatgaactccataggggagccacatgttctggctgctgtgaaatgcttgcagtcccaaaaaagaaatcaggcccagattttctgtgggagatggggattaaattaatagttaatggagaaaataaaaaaattggaagggggaggacttggacatggcttcacttcactcattcattcactcattaaatatttatgagcagccggacaaggtggctcacgcctgtaatcctagcactttgggaggctgaggtgggcagataacctgaggtcaggagtttgagatcagcctggccaacatagtgaaaccccgtctctactaaaaaaaaatacaaaaaattaactgggcgtggtgggggaggggatgcctgtaatcccagctacttgggaggctgaggcaggagaatcgcttgaacccgggaggcggaggctgcagtgagccaagatcgtgccactgcactccagcctgggcgacagtgtgagactgtctcaaaaaaaaaaaaaaaattatgagcacctgccaggtgccacatcctgtgctgggttctgcaaataagacagatgaagtccttgtcctcatggttgttcgttacctccagatgtggatgctcctatgctcctgtggtattctgttagttgttttggaaacttggttggttcattatggtcaaagttccaaattagttaagatgattaagatgttgaggtgcagagaggggaggacagagggaaggagagttgtagctgaacaaaagagccatgaaatgcttagctgttctctctttgccatactccctcatcactgcctaattttcacaatgggttagcaaatgtgaagtgttctgtaggcagacatgactccattcaaagcttttcataatcattttggaaagtggcaggaattagaagcccagcattggcagcacaggaggtaagggtgatatttattatagaccatttttttgctttgtagtttatggagtaagctaagattacaactataattatattattcaatgtttaaattttatatattatcagaacaaatattaatgtgtaagagaggcatacaatgtgaatattgagccatctctttggattcattgaaaggttggttttcccaacttatatttataaatgacttaggaccactgataatgctaatgaatttagctaaaaagtatctccagaatgatactcagacattttgtacatttagatttattctacaattcagtggggaacaaaaccattcaaaaccattttattttgaataatttagttacttcttgttttcctaatgaaagaatttgctttttgattcaaaattattctggatcaatgagacatgagggacatctatgaaaaaataaaaatctataaattatccagatttttaaaatccatatgtttaatttcatagtctagaaaaaaataacatctagatttgactattttccctaatacctggaatgtatattttagataacataaaggtagatgaagtaaatgctatgttggtctcttttcagggaaatcttgtgactttttcaacattgtatcacaatgtcggaaaaattcatgttttataatctagaattttatttgccttgctttatgtagagaatagttactttccttttgtcagaatttctaatttctaatatctcttatgctagctgctattttggtgataggtgcttttaaagaaagcttcaaatgattgtactacttttacctagtagctaacattagtttccatgacagaaggtgtgtaaactattgtcagtcttgacaacatagaaacaagatcagctttactcaagaaagttttcatttaggttaataatattagggtaaaatcccaactgagtctatatcaggaaatcttttatgatctgatattataacacattcaagaataacaaattttcctttaaataaaattagagggagttgctttgaggctgaataaaaaatatattggaaaactgtgtatagtggagatatatgttcctgctctgttgggaacccatttatctctgactctaagactaatcatgttatgaatagacgtacacactctgggcaacttgaaaaacaatcagtttgttcagctccagaaggaccctctgagatagatttcttgcctgaaaaactcttgatttgactccacctttttatgagattatcaaatatttttacatgttttgcttttgcatgtgtatgcatcccatgatgatggttcatacttgaattgtgtttattgttcatattcttttatctcattttttcttcttggtacaccatgtcaagtattactgattatgaacagatgctgtcttgatgggccgatttaggggcctacatcttatttccaaagggcttttgcatactctcactgctatttcctttggataagaattttgggactatgtatagacagcatacatgacactgtgatacttaagatcagttatattttcagatggcccatcttatccttgttagaatgacctgaagctttgtggttttagctgtaccaggatgagatgcctagagatgtagaagggtcagacttcagtagaattgcagtccaggcttgcctgtccgtgttaatggaaagatgtcatgttgtatagcagtggggtttttcagcttttttttttcaagaagaaaataatgtttttaagtaaaattttctgtagaaccccaatatctacaacaattaagaatatggagttgcccaaagcagagaaagagctgagacccactctctcatctgctttgccttctgctaggcctccttgtcaccccactccgtgacccttcaagaacctctgtggagtactaaagctctgaggaatgaaattgataaccattgtggtacgaataatttttcttttttaaaatcatcgatcattgactgaaattttttaaaaactgcatttcaaaattggggtgtcagctatctagggaaatcatgtcagttaaaataaaagcagtcccactatccaaactggaatgtcgaagaaacaaaaaccttctcatctttaccaccctaacaaaaaattaagcgtaaaaagcaataaaagttcaagtaatttgaaagccaagttgcatagcccagcctcttatttgctgtgtggatagaaagtgaactaacatttgatgaatatctactatctgaaaaaccttctgtcatgtgcattatatagtattctctaatttaaatctcacaacaatcctgggaggtggaaattattcctattttacaaataataaaaatgtggctggtggagataaagaaacttacctgagatcacacagctaggaagtggagggtctgggttctgaaccctaatctggctggctcaaatgctcataccctttctccagtcctgtgctatatttccagaaatatagtgaagggaagcaaggatattatgaactataaacacaagattgtcctgaaaaatatgtatagagatgcacttgaccacaaacacagtgtttttcatttgctgtttatataccactatatctgtgccccttccttttatatgcaatatatttgatatattcttccttcctcattcctcttctgttatgcttctctcctttcctctttcccttctctctctacttccaccttcactgttgcacagtcttaagagatatgggtcctcctctcatctagacacggtatttgttggttttaagaaatgaaaacccagttaagatagtaaagtgagaagatccttaaaagaatatagaggtacctcacagaatgcaggggcaagatgtaactgccatgccaggaagtgaggtggcttttctacctctctgtgagtgcatagtttttcttatgtctgcttctctcaaatggcttctttctgcacatctgctcttactccctctcacacctctgctcctcttaattggctccctctgcttaggaatctttagcattgctcagtatggatggcctggccctaactctgcatgggctttcagatccagtgcctggaactttcttccatatctctaagtttaatgtcttgtgggcataaggttggctcagctcagcttataaatacatcctcttttgcgttaggtgttcaaccctgatccaatcagctataatggagtgacaggtcacaggttcgaatatggtcccttcagttgagattataggtagggcctaaacccaaagatatgtctagtatactttcgtcaatactggactttacttccagatatactctccttcctttaccctaattactctagagaagaagggaaggagggagccctgtgggtagcaggactttctcctacaaaggaagttagattgttccattcagggcttgtggtggttgatgtgtttagctcaaccagatttggacatcccagagtgtggcagaaggctcagaaacctttgtaggaaatgaagtagaaaaaatattacttaggtaattacttttgcaacaacttttaaaatgtacttgataaataatattttacatatttataggatacatgtgatatattgttacatgcatacaatgtgtaatacacaagtcagggtacttaggatatccataacctcaagcatttatcatttctatgtgttaggaacacttcaagacttctctcctagctattttgaaatatataatacattgttgttagctagctatagtcatcctactccgccatcaaacattagaaattattccttctgtctaactgtatgtttgtacctattaagcaacctcttttcatccactcatccatccacccacacacccttcccagcctctggtagctatcattcttttctgtacctccatgagatcaacttttttagctcccacatatgagtgagaacatgtgaaatttgtctttttgtgtctggcttatctcacttaacataatgacctccagttccatccatgtttctgcaaatgacattttattcattttttatggctgaatagtatttcattaaaattttggattagtatgaacaacatgaaaagcctttacgatgtggcacagtcgcgttagacatggatcaaaaacgtaggtgtagttcaccttgcctgaaattgtgttacatgtacaagtggtagaaaccaggtttctataaataagatgtgctggatgctttgtttctaataaactcatccatgctcaagagagaagtatctatgatgctgttgtactttaatgcccagtaatatattacgaaagtattttaaaaatcacttcaaagatcatcatcaaaggatagtgcagtctttgattactccttgaatactctctctctacttctctctctctcattctctgtctctctctctctctctctctctctctctctccgtgtgtgtgtgtgtgtgtgtgtgtgtgtgtgtgttgagggcagctaattgcagtgtgaacctgaagtaatgcttttattataggctaaagaagtgatatcaaactttgtctctaggggttatgatttgagtagattataagggttatgatgtacaagaacttggttgaaattattctagtatgcattattccaggcttgatgtatcatgttgtgatatagcagctctcaattttgtaaacagcctaaaaaggtttctttgggactccctagccatctcttattctggacatttaactaagaaagtaaaaaagaagttcataatcaccaagttcccaaacttgtcaatgtatcattttcaggttgaagagtttttcatggaaatgctttgcttctagacaccaccccttgccttctgcacaatatcagcagatgtggtggtagcttcgggagggctaacccctctgtggttgctcaagtttttcaactttagagtcttcatatcttatgattcccctatacttcacggatgatgacttcttgcttcattggggccctccctgaccactctatctacagcaaacttcctcatccccccattctctcacttcatattctgttttgttgtccaaattttacttattacaatctgcaattattttatttaatcattttgtgttttattgaatgtatcccccatcagattgtaagctctgagcaggcaaggaccatatctatgttagtcaacattggtatccccagtgctttatacagtgccttacatataaaatgggctcaataagcattttagggattggtgaatgaagaaaacagtagtagaacactatcatccatgataacaaagcagccacagaagtcatttcactttggaaagtgaacctcttggcacaatggctgtgtctctcatgtgcacatggttagtataccagtcatccctggagaaagggatgggggattcgggcaaatcatgttatattagaagtccccacacctaccattcaaaatgaataattatcaatatttaatatacttaatagaaaaatgtccctattttaaatgtgcagactggtgatttttcatacaatgagcatacacatgtagccagcacctagatcaagaaacaatattcccaataccttggaagctcctctcatgcctgcttccagtcactgtttcttcaaggttaactattattctgtcttctaacagcatacattagttttgcccatttgtactttatataaatggaagtatacagtttctattctttcaacattatgtttgtgagatccatccatcaaccatattgtggcattccccacacttaatgtttttaaacaagtggaaatgaatcccaagacacaatgagagggcaacgtaatgaggaaaggaggctagttatatagagtgatgattggagatttatgtgctgaagtgagccatgttctattaaattcactgtgccttctttgcttcctctagccttgcttcccaaatcctaaacattcagcttacaaatatctgcccttgggaaaaatacttactaatccaccgaaaatccatctctgctactgcagaaaaaaaaaaaatcttttgagcccgtgctgtctccctgaggtgtgtcaatagtgccatttctttataccaggggcagcatttaattattgattctcaatgcatatgtcctggaggtgtttattaatctgagtttagggacattgttgtttccctctatgtgcatgaatttatgagaagacctataggggaggggtgatgaaaaaactgattaagtttctggactttacacagaaagggatacaaataggatactatgcatgatttaaaattggcaaggacaggcctccagcatgagggaatctctttgagttattaatcatgagttatatatttttgtgacagtgaaagggagctttaattaaacacaccttaataaccttcccttacaaaattcctttttaaaaataaatatggcatcaagtaatatatggaaggtgtagagtaactcttctagagttctatataatggagaagcaccccctgacaaagaaggttgccaagcacttgcacaaattactaaaaaaaggctggggaatcactggccatctgttcagcatggttctcatgcaagtgtgcctggagccatggggctagatggcatgatattagaagggaaagatcttttggttttcatttgatgattatcaggtttctttaagtctaaaaaatgccttaaaacttaagtaataaaagaaggtgttcttttggctcatgcagtgtgtcgatctctgtctctcccaagcatttttagactttatgccagagaccacctggaggcaaaagacaccatttatttaattccttccaatactagtaccacacattaaaaaaaaaaaaagtattgtgctgttgcttgcgtaaagagttattatttactgggcctcattttaaaatgtttttattgctttttaaagtggtcaaaatgacacttttaaaacccacaattttgtgtgacctgcatattgaaccagtccagacaccgcttgaaaggtctttgcaggccactatggctccatacacaataataatcaatatcacttagactacttattgggtacacactgtgtgccaagaactggtaggcactttatatacgttatctcatttaattttctcaatgatctggcaaggcaggcacaaccaccactccactaataaatgagggaaatgagtcttggcccagtcagataattagtcctcagccacattgctcatttgttcaagcactgaattatgaactcgggtctgtctgactccaatgcccacattccttccctacaccatactttcttaatactttgggaaccgtggtctacactcatttcttgatatctgtgggggattggttccaggaccccatggataccaaaatttgagtatgttcaagtcccttatacatttgcatataatggatgcacattctcctgtatgctttaaatcatccctagattacttataatacccaaatacagtgtaaataattgttatactgtattgttttttctgtttttttattgttctattgttaatttttaatttcaaatagtttcaatctgtggttggttgaatctgcagatatggaacccatggatgtggagagctgactatatttcaaataagactctgaaacaaacacaacttctgatttggatatctttctaggttcgtctggtttgttttctggtcacttttaacatagtagtaatcagtactaggtttgaaccttgcctttgccacttgccaactttgtgacctgcagcacgttacttaacctctctgaggctcaggttcctctttcatgaaatagttaaaataatagaactcacttaataaagatgttttaagaattaaaggagatgatgcaagtgaaagtatatatcaaaataatagcgagtgtgtagtagatgtgcaagactattaataacaaagatactaggactggtttttgaacttagagcaccttggcagtgtctcttctccttcccagtaattaactcagttgctctcttagaagccttttctgttccatcaggatcagaaaacgtttccttacacccagagtttaacaattgaatccaggctgtcattacaaaataaatcttgattctcatacttcaatttttagcagcctgtcttctcttccttaaggtctaaagaataaccataaaaataaaaacgtgattctgctgagacagcattagaaaaaaataataaatgaaaactaaccctaatcaaaacaaataacatatatccaagcatctcaaacctttaaaatgttgtaaaggtagaactcatgtctatttacctagccctatgattgtcatatgttctaaaccaaaaattaggacacatagtccaacaaagaattcattttcagatttgtattctgatttatagaataagatacatggaagcataacaattaagttgcatttagctatacattttctgagtcatctttattgagaagaatatgggacactataaagttgaactatcctaaagattagggacatgtgatactctacacttttcttttgaataaaagcatatcagtaatctttgaatatccttgaaaagtaccaagatagaaggttattaacattcattgcaatgttaataactttattccagaattttcttttgtttctgttgtataacttcacttgtagaacacccattaatgcaataccaagcttatagaaacacatgctttatgtaatttttagtgtcggtaaaagtgatattcagagggagaaaagataattagccccagggtttgatagacatcatttagtagtcatcctgttaatctaaaatcctacacataaccaattaaccattgtaatgagaactttaatttttaaacttcctatccaatttctttcaatcattgctgccaagcatttgaaagccagtaatgcagaaggtgctttataggcctgtgttagaaatggtcacatccccagggagctaaaatcacaacagatcacacaagtagagtgatctgctttttattgtgggcattagataacttcagctttgaaaaaagttgtgttaaggatgaaacccagcaacttttagtgataaaaaaacattttgcaaccattgttcatagaatacacacccaaggccatttttttccttgatcttttgaaagaaattgtactatctgaaatgaattcagataaaggagattgaaggcagtggatgttcataaaattcttgtttggatgtggcaggtctctgggtggtttttgctgtttaggaccttctctgcttctctcccatccacttttctcttgtacctattcttaaagagaccaccctgttagtttagagtgattcatttatactagtggtgaaaaggcattttcatccactaccatgaggtactattaatctactgggccttcataaatttcattgtgaagggacttaatttgtttctattatgagaacttttgagcacattcagttatcataatcaaaaagcacttaactgcatgtgtgctgtgccaagagaattacagagacacattttcttccctctgagtgttcaaatttagcagtgactgccaggttgtgtggatcactgtgtggagggacagaatgatgcatgatcttggagagcaaacttggggctaaaggtatcaggccaaaccagcaaacctgtgtcataattgggagtttcggggaaactagtggttgatgtgagaaatccagccatgctggaggcacaaacagaagcccagtttggtatatgtagactagagaactgcatccagaggattaagcatggtaagagggtacaagactggagtccaaacatacaagcaacttggtcaggattcatttcaggcaagaagaaaccgggaatagagttttagcccagattcaaaacaggtagccatgtcctcctaattacacagccatggtgaaaaatctatattccttcatttgcccctgattttaaacagcctttctcttgtatttggatctggaatactggtttgggctgcttcctcaggtgaggcaggctgctgcagactatgtgtattataacatatactgatacactacagtgagctcttgtaatcttacctttatcttacctttgagacaagattaatatgaacaaaacacttattcaaaggtcagatgatatctagtgtctggggtgtggttgcagtatacatggaccttttcttagaactccccctttcttggcaacgaaatacaaaaatcaggctgacttccaccaaagcagcttttaacatttacaactgaggaaaccaactgatatctaaacagaaggttttttccaatcttttcatccctaagggcaataggcttttcagaaaggcaccttggattgtggtaaactccaatgatcagtaaatctgtccattggtaagtatgaaatcagcccgtttttaaaaaacaatttccaatttttatttatttatttatttttctggagcaaaggcgattattctcttagttacaggacttcatctggacctctagtttgatgacagtagccactatactggtctcaactgggacaaagatactatttctacatagtgtaaacactgacctgataaatagatactactgctcttttagaataaagccaaacataaaccttgaagtaagtgagaggggaggagacaaggactttaggggatgctttaaaagctgctaatttctcttgatgccattattcctctgtgcatgcttaaaggattatcttgatgttggagtaatgatccggagagtatcgtttgtaaccttgggggtagggatggggtgatggggaaactgttctaaataaactctgagacagtcagttcaagaagaaaattaaggctacaccttgagtttgacaaattaagttcttagtgatacttgaagaattaccagtggcctatgttcctaagaaaggagtaagaaggccggacacggtggctcacgcctgtaatccctaaaggccctccctttaggaggctgaggtgggcggataacgaggtcaggagattgaggccatcctgacgaacacggtgaaaccctgtctctactaaaaatacaaaaaaattagccaggcgtggtggcagacgcctgtagtcccagctactcgggaggctgaggcaggagaatggtgtgaacccgggaggcggaggttgcagtgagcagagatcatgccactgcactccagcctaggcgacagagcgagaccctagaacttaaagtataataataaaaaaagaaagaaaaaaaagaagaagaagaaaggagaaatgggagggaaaggcactcatcagttaggtatattttaccttcataataatgttatgagtgtgtatacattatcatcttcattttatagttgagtaaaccggagctcagagaggttaaataacttgtttaaacactgtagttaagaattaggccctaaaggcaaaggcaggtgagcctgtattctggcttcccctaatttctaccagtatgactttgggatagctacttaaactttctgtgcctggtttccccatcaataaaacagggacaataatagtacctacaatcaatcataggaattttgtggatatttaatgagataatatgtataagtcacttaacagtgttccagacaccaactactcaaaaagggtatctgctttgtagttatcaccgttatcagcgttatccttaccccctctatccagatgtgtcagacaccaaagcttatgttgtttctacaacattatagtgcctcctagtggtagcaagagtggtggagccagagaaagtcaatgtgcataagtagaagatgaaaagataaggccatgagaaaaatgagaaaaggcaaaatttaaaaggaagataaaaggagctttatactaacaggtgtaatcactagaagctcacttgtaagcagttgtctcagatgccatactcagtgtatcctgcactagaacaaccctttctctctgaacccctgaggttactagattgtggagaatagaaccccatgtgaccactcaatgagactcatggagaggctttcattaggctttgtttgagaaagccactatgtagagctcatctaatagatctgaaccctaactcaaagacattttcaaactagttccaaggccatgcacatgcaatgaaaaacacgcttaactgtgggatacagggaataatcgatcattaaagtattaattaaccaaatttattgaaaattgaaatcaccccaactgtcaaatgagtcatgctccatggactttctgcgttctaaatattgctcaaatcatgcaaatgttgtgtgaaactgttatgttggccgctttaatgcaatttcacctcatttacatgaattttgatgttgcttagggatattcaatacaacagcacccaacaaagtactcaagtatgtacaaccattggaagagtaatgactgtaacatgtctagatgtacaagaaagctagcttcttataacccagattgagctaaattagcctgatgaatgcatttcccctgctattgttggtttgaccttcatttcaatataaaaatgacagaaaataggaccctttttatttgtttctctagtagtcatcaccatttctactgattcattgtcagtccctactccattcttcaaggcaatcagccaaatgcctgccaccagagaaatccctggttccaagcttaagtcaccttcataagtactgaagtgcaacatacaaaactattggacagcagttgatgaggatttaatcctttttggacaggtggcacttttaagttctgggtagaaaattcccacattttgagatctggaattttgacctggtagagcagctgataccttaaacaaagcagtgttctctttattcactaggtggcaggagctccttaatatatatgtgagggatggctataaacacatgtttagactagtgcatcagtaaagctgtcttttagagacagatacatgaaaatgtgagccatgaaatattaaaccagagcctatgagaaaagaaatcctctgtgttaaccacagtagcttaggatttaatagtagtagaacaaggtgattgtttctttaaataataacaatttgaagaaattccattagtaggtttgtcaaaatgaagtgaattaataaaatactttattcctatgtgttttgctgtttgaaaatttacttccttcaagtctctgctgaaatgtcattttatcagcaggggcttaccctctcttatactccataaccctctgatgttgctttgttttactctacagtacctattacattctgacatactttatattttacctgcttttttatttaccgagtgtctcccctatcccctctggaatgaaagctctatgggaacaaggactttgttttgttcattattgtattcccaacacatagaacactggctggcagataatgggtgctcagtatacattcaagtgaatgcgtggaagaattaccaaaaggaaattatttttaaaagataattttaaattcaacttttaagtcagcttgtatataaagccaagctgatttgtatataaagtcaagctgacttaaaagttgaatttaaaattatcttttaaaaataatttcaattataatcaaagtaaatcatattatagtatacatattttaattttgttttgctataatcataaaatattaaatactatcatcacctaaatggatgtctttatgttaacacttgatggtatctaaggtaattaatttttaagtaattatgccaaatttgcctgctgtttttatatcattaatcaagataatgaaccttgtcattgataacactatgatttactagtattttgctctttaatttcagtttttacttctgttttgagtagtagtataatattttagaaaaataaggaattaaaatggtgataaaattaggtgaatttagagaatgcctgtattgttatttttaaaatatccaaactgcctctacaagtacatctttgaagttttggttgtagcatggtaaagagaatcttagcaaccagataacttttgaaaaaacactgaatgtttccaagcttcaatttccttatctataaacacaagatagtaatttctgtcctgcctattcataggattattgagatatataaaaattatctgggaaatgtaaaattctattcaactgtaaggagttatagatgatgctagtaagtaatttaatttgtctaatgattttaggagctacagcaatcccactcctaggtatttgctctgaagaaaggaaaccaatatattgaagtgatatctgcattccaatgtttgttgcagcactattcacaatagccaagacttggaagcaacctaagtgtccattaacagaagaatggataaagaaaatgtggtatatatacataatagaatattattcagctataaaaagaatgagatcctgtcatttgcaggaacatggatggaactggaggtcattatgcttagtgaaataagccaggcacagaaagacaaacttcacatgttctcacttatttctaggagctaaaaattatagtaattgacctcatggagatagggtgtaggatggttactagaggctgggaaaggtaatgggggtggggggaagtggagataataggtataaaaaatagaaagaatgaataagacctagtatttcctagcacaatagtgtcactacagtgaaaaataatgtacattttaaaataacataaagagtataattgggttgtttgtaacaaaaataataaatgtttgaggtgatggatatcctgtttacccttatgtgattattatgcattgcatgcctgtatcaaaatatctcacgtaacccaaaaatatatacatctactatgcacccaccaaaatcttaaaaagtactttgtttttaatactctcttgtaggactttggatatgagcgctgtcttagctcaggttgccataacaaaatacaattcactggatgacttcaataacagaaatttatttcttacagttctggagtctagacgtctgagatcaagtttccagccaattgagtttctggtgaaggtacttgtcctggctcgtagacaactgccttctcactatgtctttacatgacctttccttagggcttgtgtgtatagaaagagagacaggagttctccagcatcttttctaataaggtcactaatcctgttggatcatggcatcacccttatgacctttttaaccttaattacttctttggaggccctatctccaaatatagtcacactgaagggtagggcttcaacatatgaatttgggggaaacacaagcattcagtccataaccaacaccaacagcatcagcacaataatgttcataataactttttttgagcactttttttgtgtgtgccagttactgtgataagtactttaaatgaactatctcattgtttcagtcagttatttctgtggcttatcacaatcacttgaggaccagtgagaggggcttttctccatgtaattatttaaaacctaggctctttccgtcttgtggctgtggcctcctctgagttctagaagttctttctatttagccggtgaatgggaaaagaaaataaggatagcacatgggaggttttcatgggccatgcttagcagtgccacgtgaccgtttttcattagcaagaatttagtcacatggctatacctaatagctgagaaatgcagtcaacctgtgtgttcaggaggaggagaaaagggcaatacagttattagtgtagcattagcagtaactagcatactcatttaatcttcatagtaatctaaatcggtaggtaccatcattgtccctattttaccaatgaagagaaggtatttgctcagtgtcacactactagtaatttaaattgaaactcagtctccttcagagggttgcttttaatcactgtgctcttctttctgaactaggggtaagagtattatttcattgctatagtgaatgtttgaaatgtttgaccatctctcagagatgttttaatagatcaaaaattttgtttagttataatttgtttagttactaaagaaagaagggaaagaaaaaaggaaggaaggagaacaaataaggacaagctttttgtggaggggttggatgctgtttcttatatgcaatcatgtatacttgttaataccattaatagcttattcacctttagggtctttttccttattgacataatttttagagatacttcgaatgtgtttagtgtttggctgtgacatcaaagtatatggagtcctttgcctgtctctgcctaactacctcttcataagggaggttgtactgtccagagagaccatataaagtcatcttagaatttaaagtcatttgtccatattgagcacaaattggaaggtcaaggactaggatactgcttcccattgggctaaaggattcctgaagtgatctaaaacaggagggatgggaaatctcccttcccttttacctaagtggttacaggactaaactaaattacagtaggttgccacttgttttttgcatcttgatgggttttatagccacctggatggggctgcctctccaatgtaccatgttgaatggtgcattgtttgatttacaatgttcaacaaacatactttcttaaatctcttctgatattttagttgaaagttcattttctttttatagacagcacaatactatcctaattctagctaagttatgataacaaactacagaatatgaacttctaagcttctaaaagttatcttcataccattcagatggtatgcttcttaaaatgccaacatattacaaagaccatttaattcagccttcttgaagcacaagaagaaatgatctttctagcaaaactgttttcctgccatactaagtcgaatttctccaatactataagagttctggtagcttttgaaaaaagtagtagagtgggggataaactgtttagacagcatgaaataacttaaaattttcctgcttatattgaagagagtagcaatctaggatagtttcatcttaaaataaatttgtgttctgtggttgatagtaaaggggtagtagggaagtgcccttgactaacttgttccattatcaaaagccaagtcaggatttttgcatgtgcatatataagtggccaaatgagagttcatagacaatgatattacattcggctttcttccggcagtgttgatagtaataataatacggatcaggcctgtcttaccaatctgaaacaccctataatctgaaaaaacattgaaatcagacgtgtagaactgaattagagatgtgtgggtattaaaatactccatccaacccatttccacatgtaccatctgttgtttccagatgcactgcttcctagaggcagtattcatgggcatggcattataacaccaacaaatcggcatttctacttctgggacttaattcccagaaatacaagttttcattggctgcacttcagggaattagacttttctgtggctagggacatgccattacaaccatggtaatggaaatagaccaatttagagcatataaggcagcagggtgccttcaaattggaagcagtacaaagtttctctgatgtgtctgtaactcaaggtaagttgagtaacactattaatgttccccccttggtacttagatatgcctagcacattgcagataagttgttggaggtacctcttctatgttaagtttgataagtgaagttataaaatgcttcaaaggctctggagtatatgcttaaagccatgtatatagtccagcaccttaatctgatgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacaaaaggagtcttcctggaataaagtattttcaaataaatggtaagataagtgtgataatctcctagactcacattacacataaattagtttgctatgaataattatttccaaaggcttagtgtgcattgaagtaaacgtttagaaacagccagtttgaaccatttaaaaaatatattttggtttaaaataaggaaaaaagaaatgctttgggactagcatatatggtcatgatggagtttatttatttgtagccatagtatttgaatgacatcttttgatatgctttaaaatttcttgttggctggaaagtaaagaatcatgactacagatgtcaagtttaactgccttcctccaaagtgagtcaaacgattcttatgatgtattgattctataccactaagttactaactatgttgtgggaggaacctgcctcctcaagatagtgcagctttacatcagacagggacatcaaggtcgtcatgaaggggaaatttaagacatggaaataactagaacagctgggcaaggttaaagcactctggcatgcactggcgaaagcagggcagcaaagcctgcgtctgtaagcttccagaagaggtgaaaaatccaaagctttggaccacttttctgcggaaaaggtaaagctcaaactgtcgtattggatctgtacatgctactaccttattttcttgaaatttgaacttgagacaggtaagaagagtactgactcaagtgtagcgagaggttatttttaataaggattcatatttaaaagtttagttaatcataggactggacttccacagagttaaaaaaataaattctaaatagtaatttttaaaaatcatatttggattagatgtaaagtgatctggggctgtaatggatatttgtttaaagttatttcttcactaatctgttattagccaaacctgatgaggtcatgtgtcgatttattggcaggatcaaaggaacacatttatttaaggtggtatatttgttgatctcccccagaattctctagatgtgagttgatgcaattcaatagctattaattccactttaataatgagtttgacatttatatttttacaatatcttaaccagccttttcaataacatgatccaatgatgcagaaatttgtttctaattgtacaggccatcattaacattgttgtttaccctgaaggcatttgaatgcccttttgaaataaaagttaagggctattttgacctagatctttaaaaacaagtaacacttttatgcaaggacactggttaaattgtggggtgcagacaaaaatattcaccaactgtcaaaagaggctgagaagttatttccactccaaaacgtctgtaattcactaggttagacaaagaggcacattcgtgaatcaagggaattgttttataaaaatgatgttttagaaaattgccttaacatcttacacactttaagtttggaatcaagaaattctgccttttacttacctgtcttattaattgttttaaaatactgaaaatatatacatatgcatcatggatggcagaaaacacatatgacttggcatgacagttgcttgaaatggaaaagcaatacaatgactttgtacttttatgaaacacatagattggtaataaagctgcttcctagtcgcatttggtcgccacaacacccaagtgatttgtgtaattattgttttatctatctttttaaacagtggaaaagtcagatgaaccaaatgacccagtgctcatttttattgttaccatccttctactagatgtacagtcatagtcatttttaaaagaaaatcctgacttttcttatcatatccaaaaagcacgtcactaaattctcatatcttgtgacaactgataaataatagctagagtgtattttttacactaattgtgattttaaacaacattaagaattggttgcttatatggggtaagttgaaacacatagataagcccttttaattgaatacttggaactacacaattccaaattagtcatgtaatattttaagaagagaaagatacacgcattgggtgccttctctgggccaaacactgtcacacatgtaatggcaacttcagaacaacagtgtgcagtagttatttttatccccatttttatggaggaagaaacccaacctcaaagatgttaaacagcttctccagcatcacaccagctactcagtggcagagccaatattcaaatgtacatctgcctgtttttaacttctacattacaaagcatttaaataaatgtggaaaatatgttcgataataatggctaaatcaaaatgcattggagtaaatctgtgtagtactgttcatcaaggtaaaagtatgcattttgtttgttaaattgttttatacaagacactggaataaattaaatgcatgagtgatatcagaatttaaagcattgtgtttattaatgttgttttataagttacaattatttaattgaggagcagtctacaaaaatatttaatggcaaaagtagagttaagttatttgcacccacacattcataaaattttgttttgtttttttaagacagggtctcactctgtcacccaggctggagtgcagtgatgtgatcatagctgactgcagcctcgacctcatgggttcaagagatcctcttacctcagcctcccaagtaggtgggaccacaggtgcacaccaccactcctggctaattttatttttattttattttattttattttatttttttgtagagatggagttttgtcatgttgctcaggctggccttgaactcctgggctcaagtgatcctcccgccttggcctccaaaagtgagggacttctgggggtgaaccaccacacccaaccttggtttttaaagctgggatttctatttttcacaaccttatttataaaacaagccaaataccaaaattgaaaaatgatatggcttcatttgaactatctgttgctatgtgtaaggaccgttaaagatattctggtacaaattactctttaaaaagagggcttaaattaagtatgttcagttgtgtaatgtacttttggctttaggttataatgcaatcagttattttgctgtgattcaatatttacatgtttctgctgaagaaaaagcccagtcactacagaaagaaattgtatgattctacatgtgtagaaatcttgtgatataattgcattctcattatgtcttctactagtaatttatgaatattcaagatttttattttatttactttcaacccaaatgatatttttttctgcagaataacagaaaaaacttaaccctagaaatgactgttttttaattaaaaataataacccttccagaatatagagaaaaataagtttctacttattcaccaaataaataaatgctgactatcataaccctttaagtctgtatgaccttgtagttctataacctccctgaacccatagttttcttaactatgaaatgaggtaataactacttccctgggttactatggttgatacttaaatagtataatgcatggaaaggataaagaactgtgcctggcaatgagtaggtatcaagttgttattgaatcagttaatttgttgtgcatataattaagcaatttggaaatatgatttaggaacatcttataatctgacccagaaattgattttaaaaatgaatgaaatttcaattacagtgaagttgcttatcagattcccttgatagcttccccaatattgatcgaaatgatctagacctctcaggagcaccctccttcactaggtcttagccctatactccctctcttgtgttttactggtttccttctcacagtaaagcattttgatatgggtgtttaacatgactattttgatggagtcatattgacataaccacatccaaatatctctatattaaccattaatatattaacaggattatattaaccattaatataaaaccattggccattggtttctttacccaaggactgtgtatcatatcagacattttgaacttagttccatctcttagtatcccccagcagacttcatggttctttcactttctactttacccatttttgttttaagagacagggccttactctgttacccaggctggaatgcagtggcatgagcatagctccctgcagcctcaaactcctgggctcaagtgatcctcctgcctcagccccaagagtagttgggactacaggcatgtgccgccacacctggctaatatttttaaattttctaagacatggggtctccctatgttgcccaggctggtctcaaattcctggcctcaagtgatcctcctgccttggcatcccaaagtgctggtgattacaggagtgagccaccacatccggccttacccataattgtattgcttgactttttattaaaacttattgcttttgtagtcataaaaacagaactcttttaaaaatgtttacaactgagtcaacctccaaggggagggatgctttttacccaaaaactaggattgtaaaacagtgttacctcatagtgtatatatgctactgtagaaattgttagagaaaattttctcataccccatccccagtgtcttacgagatttgaaaaatcaagaagcctacacaaataagtagccatttaaaaatattttctactggaaaatgggacaaattccacaattacattgctaaatctgtatttcagtagagattaaataagtatggcaattgtaaaccttaagagattagacaatttagaatggtgaccattcagccaacaacataaattatggctgctgcccctttgtgagaaaatcatgtgtgataaacatgtggcccctagttttatgtcgtgtggatgccacatggtgccttatcccaacctcgttccctaccccatttctgagcttcttgtcatttcatagtcttctggtatatagatcagggataggatgaggtccaaagataagaatgaggatgtttgtttcacatactgcttgatttaaaataatctgactataaaccttgtcacgttatcaaaatatcaggtaccctattccattctttgctgtacacttgtctcctcttgatattgctaaatcatgaataataaagaatatctattaagaaatgtgcttttgagactaaaagttaaccccactttaatgataacatgttggaaaatacagtggaaaggctagaacatgtgcagaggataccatttactcatgccataatgagaaaaatatgaccaatttggaggggtctttgtgtataaaacaggtctctttgcaagagacctgttcaactatacatatatgcagcagtaagcaaatatttgagtgagtagaataataatagcaagcaccgatgtgggattaactggtgatatattttataaggccacgttcatcatggtatatcccatacaacaggcagatgttaagatgatgtcaataattatgaatttgttgagcacccatgagtaatttgcttttttaacataatggattgaacacattttaattcttgccttttaaaggcttccatatgaagccttctaaaggggatcacataacatgctaacatacaagtgattgtaaagaagaattagttttgaaaatgttgttcagataagaacacatggacacagggaggggagcaacacttactggggccgtgtggggggcaggttgggggagggcattaggtaaaagagctgatgcatgctgggcttaatacctagctgacgggttgataggtgcagcaaaccatcatggcacatgcttacctatgtaacaaacctgcacatcctgaacatttacactggaacttaaaaacatacatagttagaatgagaatgacatgaaattcattaaggttgacatttaaattcatgaggttatcaatgcttatatacttattaaaatataaagttgtttacggtaaaaaaaataggaaatgttgttcagacaagtatttaaatattgttagtgcgtaggactgatacagactgggttaatctggaaaaagtctcttactcaagggaaccttaaggtgaactttctgggaaaaggttatgttatttagacagacttttgtagtagaagtattgaaggctgctcaaggtaccccacaatttatattattttcttattctagagaggaagagtgttgtcataaggaaaagttaatgaagaaagaccgacgtaggatttggttgagtttagtacatgctgatactatggtagcactgtatcataaactagtactataaagactattatatactacccacgcaattataagatgacacccattcatttccattttcatcatcttcattttttttctaggatatttgtagcttataaaataggataacctgattaaatttagtcctttgaatcacgaattctagattatttcctttttaattctgggagaacttaagccatctgttgccttgaagcagagagatttagtaatcaggcagagcagtaagaagatatttgtctagggatattattaattaacaaacttggaaggtattcttcattttttaccttaaagtcaaagtacccccaataagtacattggggaattaggctagaaaacctgtcttgggtcagatactctttgtgttctgctttgtatagtgcagaagaaaatgtaaataggtgttgggtccattacgatgaaaaaaaaaaaagcagtaaataacaagaattgttttttgtgaggtcccaaaatagtgcacatttataaaaccccaatatttcaaaacaaatattatgttgtttttacataatccttttcacttaaaaataactgttctcaccacagaggtgataactgtttaaggtgatggattttttgattaacctatttgatcattacatcacattgtaccccataaatatgtgcaagtgttgtgtaaattaaaaataaaataaaacattaaaaaagctgttgtagtgtcctttctacttaacttccatattaaaattgaaaatttcaacaacagtttttgaaggaactagaacaagtttttttaaatcaaatttatttaagtacagctattttgcaattaaatggacccattttaagtgcatacactgatgagttttgagaaatatatatacacatagagtcaccacactacccaacacataggatctttccaaaaccccatgaatttctcttctgcctcttcccagtccattctcattatcccaagcctcagggaatcactgatatactttctgtccctatagattagatttgtcttttctagaatttcatatcagaggaataatacagtatttacttttttacatatgagttcttaacactcagaacagggtttgttttggttttgtttcagtatcttttcagcacatagtattattcttaatgttagacgttctaatagatgtgtatcagtattttgttgtgattttaattttcatttcactaataactaatgatgttgagcatcttttcgtgtgcttaatggccatttgtgtatatttttggtaaagtgtcacttcaaatgttttgcccattttaaaatactgggttgtttatcttcttattattgagtcgtaagagtcttttatatattctagatacaagtcctttgccagatatatgtattgcaaacactttctcccagtgtatggcttgcctttttattttcttaacagacaaaaacttttaatctttatgaagatcaacttaacttttttttctttaacagctaagtgctttatttttcattttctatttttatatatttaggggcacaagtgcagatttcttacatgcatatattgcatagtggagtagtctgggcttttagtgtacccatcccccaaatagtgaacattgtacccaacagttaatttttcagccctcactccccgctcactctcccatactttgtagtctccaatgtcttattctgctctatatgtccatgcataccctttgtttagttcccacttagaagtgagaacatgtggtatttgacttccttttctgagttatttaatttatgataatggcctgtggttccatccatgttgctgcaaaaaaacatgatttcattttcttttcatggccgagcagtattccatggtgtatatatatataccacattttatttaccctgtcatccattgatggacacttaggttaatttcatatttttgctattgttagtgttgcaataaacatatgtgtgcaggtgtctttttgatataatgatttatcttactttgggtagacacccaatagtgagattgctgggttgaaagataggtctatttttatgttttgagaaatattccgttttccataaaggttgtcctactttatgttcccaccaatagtatataagcattcccttttctctgaatccttgccaacatttgttgtttttttgactttttttttaaattatagtttaagttctgggatacatgtacagaacgtgcaggtttgttacctaggtatacacgtgccatggtggtttgctgcacccatcaacctgtcatctgcattacgtatttcccctaatgctatccctcccctaatcccctaccccctgacaggccctggtgtgtgagtttcccctccctgtgtccatgtgttctcattgttcaattcccacttatgaatgagaacatgcagtgtttggttttctgttcctgtgttagtttgctgagaatgatggtgtccagcttcatccatgtccctgcaaagcacaagaactcattcttttttatggctgcatagtattccatggtgtagatgtgccacattttctttatccagtctgtcactgttggacatttgggttggtgggttggttccaagtctttgttattgttaacagtgctaaaataaacatacgtgtacatatgtctttatggtagaatgatttacaatcctttgggtgtatacccagtaatgggattgctgggtgaaatggtatttctggttctagatccttgaggaattgccacactgtcttccacaatggttgaactaatttacactcccaccaatggtgtaaaagcattcctatttctccacatcctctccagcatctgttgtttactgactttttttttttttttttttttgagacagagtcttgcactgtcacctaggctggagtgcaatgacacaatctcagctcactgcaatctccatctcctgggttctcatgactcttctgcttcagcctcctgagtggctgggaatataggcgcacaccactacacctggctaattttttgtattttcagtagagacggggtttcaccatgttggccagactggtcttgaactcctgacctcgagatccacccgcattggcctcccagagtgctgggattacaggcgtgagccaccatgcccagccgtttgctgactttttaatgatcgccattctaactagcaggagatggtatctcattgtagttttgatttgcatttctctaatgaccagtgatgatctttttttcatatgtttgttggccacataaatgtcttcttttgagaagtgtctgttcatatcctttgcccactttttgatggggatgtttgttttttacttgtaaatttaagttccttgtagattctggatattagccctttgtcagatggatagattgcaaaaattttctcccgttctgtaggttgcctattcactctgatgatagtttcttttgctgtgcagaagctctttattttaattagatcccatttgtcaattttgggttttgttgccattgcttttggtgttttaatcatgaagtctttgtccatgcctatgtcctgaatggtattgcctaggttctcttctagggtttttatgggtttaggttttacgtttaagtctttaatccatctatagttaatttttgtataaggtgtaaggaagtgtccagtttcagttttctgcctatggctagccaattttcccaacatttattaaataaggaatcctttcctcattgctttcgtcaggtttgtcaaagatcagatggttgtagatgtgtggcattatttctgaggcctatgttctattccattggtctatatatctgttttggtaccactaccatgctgttttggttactgtagccttgtagtatagtttgaaatcaagtagcgtgatgcctccagctttgttctttttgcttaggattgtcttggctatatgggctcttttctcgttccatatgaaatataaagtagtttttttttttcgtaattctgtgaagaaagtcaatggtagcttgatggggatagcattgaatctataaattacttagggtagtatggccattttcaagatattgattcttcctattcatgagcatggaatatttttccatttctttgtgtcctctcttatttccttgacaagtggcttgtagttctccttgaagaggtccttcacatcccttgtaagttgtattcctaggtattttattctctttgtagcaattgtgaatgggagttcactcaagatttggctctctgtttttctattattggtgtattggaatgctgtggtttttgcacattgattttgtatcctgagactttgctgaagttgctcatcagcttaaggagattttgggctgtgacgatggagttttctaaatataccatcatgtcctctgcaaacagagacaatttgacttcctctcttcgtatttgaatacccttcatttctttctcttgcctgattgccctggccagaacttccaatactatgttgaataggagtgaggagagagggtatccttgtcttgtgccagttttcaaagggaatgattccagcttggccattcaacatgatattggctgtgagtttgttataaatagctcttattattttgagatattttccatcaatacctagtttattgagagtttttagcatgaaggggtgttaaattttatcgaaggccttttctggatctattgagataatcatgtggttttcgtcattggttctgtttacgtgatggattatgtctattgatttgcatatgttgaaccagccttgcatcccagggatgaagccaacttgatagtgttggataagctttttgatgtgctgctggattcagtttgccagtattttattgaggattttcacatcaatgttcatcagggatattggcctgaaattttctttttttgttgtgtctctgccacgttttggtatcaggatgatgctggcctcataaaatgagttagggagaagtcgctgtttttctattgtttggagtagtttcagaaggaatggtaccatctcctctttgtacctctggtagaattcggctgtgaatccgtctggtcctgggttttttttggttggtaggctattaattactgcctcaatttcagaacttgttattggtctattcagggatttgagttcttcctggtttagtcttgggagggtgtatgtatccaggaacttatccatttcttctagattttctagtttttttttgtgtagaagtgtttatagtattctctaatggtagtttgtatttctgtgagatcagtggtgatatcccctttgtcattttatattgtgtctatttgattcttctctcttttcttattagtctggctagcagtctatctattttgttaatcttttcaaaaaaccagctcctgggttcattgattttttcgaaggttttttcgtgtctctatctccttcagttctgccctgatcttagtttttgaatttgttttctcttgcttctctaattcttttaattgtgatactagggtgttgattttagatcttttctgctttctcctgtgggcatttagtgctgtaaatttccctctaaacactgctttagctgtgtcccagagattctggtacgttatgtctttgttctcatttgtttcaaataacttatttatttctgccttaatttcgttatttatccagtagtctttcaggaacaggttgttcagtttccatgtagttgtgcgattttgagtgagtttttaaatcctgagttctaatttgattgcactgtggtctgagagactgtttgttatgatttccgttcttttgcatttgctgaggagtgttttacttctaattatgtggtcgattttagaataagtgctatgtagtgctgagaagagtgtatattctgttgatttggggtggagagttctgtagatgtctattaggtctgcttggtccagagccgagttcaagtcctgaacatccttgttaattttctgtttcattgatctgtctaatattgacagtggggtgataaagtctcccactactattgtgtgggagtctaagtctctttgtaggtctctaagaacttgctttatgagtctgggtgcttctgtattgggtgcatatatatttagggtagttagctctttttgttgtgttgatccctttaccattatgtaatgcccttcgtctttttttggtctttgttggtctatagaccgttttatcagagactaggattgcaacccctgctttttttgctttctgtttgcttggtaattatttctccatccctttattttgagcctatgtgtgtctttgcatgtgagatgagtcttctgaatacaacacactcattggtcttgactctttatccaatttgccagtccttgtcttttaattggttttaataataaccattctgactggtataatattgtatctcatggggttttaatgtgcatttctctgatgattagtaatggctagtggctagtgcttttttgtgtcctgtgtgttcttgcatattccaagatcatgacagttttccgctgcattttcctctggtagttttatagttttagcttttacatttaggcctataatacattttgagacaattttttatctggcatgaggtaagagttgaagttcaatttttccttatggttattcagttatgttagcaacatttattaaaatattatctttttctcattgaattttacctttgaattttattcaaaaaccatttaaccatatacaggtggatatatttttggactccctattttgttccattagactatgtgtagtatatgctgatactacatatcatgattctttttcaaaatcatttaggcttttctaggtcctttgcattgtcatgtaaaaaattggctcgtcaatttctaccacaagagcctggggagattttgactgggtttgcttagaattcatatcattttgaggaaaactggtatcttaacaagttgagccttccaatttataaacgggatatcactccgtttatttagatctttaatttttctcaatgatattttctgctttctagtgtacaggtcatgttcttttgttaaatttatgcctatatataataacaaatttttaaaaattaaatatcaagagagaagagacagtgaaacttatccaggagtgcagcctgttttcgtaaaattaatttgtgattgacaccaacaagccttctgatctgaaatttcaagtgttctggtgagtaattggaatttgtgtatatctttttttctaagctttttatatcaatgtcttttaaggaagcaggcatatattctcctcaatgagaatctccaaatgagccttttactttcccctaaggtttggcttccttatgtttgactattgccttatacatgttatttgttatacatattatacatgttgtttgttcattgacttattggcataaaggccataaaaatactttttcctccttcagaagtctcttccacattaatagctttatctagtagctcagttatggaaactcacaagcctacatctcgagcccaatatttatcaaaactctagttgtaaatcatctattttttgctgggtgtttccatatgtaaaggtttgttaatttaagcatatctgaaaccaaacacctctcccctcactcacacacacacacacacacacacacacacacacacacaatttcattaaacaaacacattgctactatctggtacaaatagatgagtttaaatcctaatgtaaaagacataaatggaaacaaagtttcattgcataatctgaaaaattgcataataggggtaaagaaagattattatggaagcatctaactgttactggtgggttcaggcacttcacaaagaaggtgatgcctaaactgggacccctcaaatccatttttgttcatcaggttgaataaatcataaaataattttgtcattcataatgttagtccactccatgtttgaaaaattgtagttattctcgattcttttctttctcttgcacctcaaattcagtcagtgaatactatcagttttatgcattgtagcacggtcattaaatgtgttgactctaaaactattcccactgtatttgaaacctgatcccagtccttacttgttgtgtattttggcaagttattcttcctctctgtgcatcagtttatttttctgtaaaatgcagttaataattatacctacctttgaatgttaatataaggataaagtaagatagtaaatattaattctttacctcagtgcttagcccatagtgaagtattcaataaatattcacagttatcaataatattgttatggcatcacttaaatattttctttcctttccaacacccttgaaataaccctggtcactcttttatttatttatttatttattttaatagaaacgaggtctcactgtgtcactgtgttgggcaggctggtcttgaactcctggactcaagcagttcttctgtctcatcctaacaaagttctgggattacaggcataagccaccatgcccagctccccaatcactctttacccttgctactgtagtactgaatccatattcaaaaagttcatatgtatgttgattgtttaggtgcaccgcttgcattttctcatagaaacagtgttgtgaatgatggttaaattaacaggccagtccagcaaaaactaatttaatgcaaatctgttaaatatattatcatgttgagtcctctataacctagctattgcataataagtgtttttcgattattcaacaaatatttagggagtacctaccatgtgcccagaactatttggtgcttagaatataccagtgaacaaaacaaagattctgagcttgaagagctaatgttctaaaggtagaagttaggacttctttacaatcttacagccttctgccactactttctaaacttaaagcagacacacagctttttggaagacttctaaggcatttccatggtaggattctaagaaagacaacaaatgtttaaagaggctcccttccatactttcttattctcttggttaattttgtctctggagaaacaaattggcacataaaaattagcactggatctttggctattcaaaatgaagttttagcttcatttgagaggagaaacaattttaagctacagaaaggcatttttttctgcagaaattggatgggacttatgctgtcagtgaggacccagaaggaaaaaaaaaaatgggataggggaaacagcagctaggacagtgctggtgagagcatcttctagggctttattcactattcccttttccctcaccacttcagccttgccatttcagactctccagtggaatagcctgaatgaaaagacaagaagagaaaaatacccataagcatgggaatgagattttaagcttttgggatggaaagggaagggaaggaaatcacagaaactggctctagtaaaggatgtcagtttctgtcctcaaatgcctccagggtatataaataagtcagaaatacccaacttagattttgacagcaaacagacctgggtttgaatcctagctcatacatttatgacctttttacgtttggcaagttatttaaccactctaattctttgctttctcaattcagagttaatgagagggagcaccttatggatatgattcttgctaggattgaatgagataatgtacataaagtgcttataagagtgactggtacatagaaagtgcccatccatgaaaattagttcttttcttctgtcccataagaattaatttcattgtttcataaacatcaatgcatcctttccttccccagtccaaactatcctagatactacagcttagaaatcgcttaaaacaccttttggatctgctatgccctgccaaacaatctccaatggatccccatcacctatggggtaaagtttaaacttaggctagtattcagagtcctccacaatctgagcccgactatttcctctcggcaatcctacatgaacattttactcaagcccgatttgtcgacactagtgtttctctaacagaactcagggcttgttgtttaaggatagagccttgattttgccgggaggctagtggtatgatggtgggggtgctgatagcatttcaaacaggggagggcaggatcagagaaaaaccatgtttctcttttctctctctccctctgtcccatgaagtatgcctagattgtcttagccagaaagtgtttctttaaaagaccaattactgttcctgcgtgtttgggggagtggggagggcgatgggaaggagagcatcaggaagaacagctaatgggtgctgggcttaatacctggatgatgggttgatctgtgcagcaaagcaccatggcacacgtttacctatataacaaacctgcacatcctgcacacgtacccccgaacttaaaataaaagttgattaaaaaaagaccaattactgagtcccagttctataagtcatggtgctaagaatgggcactacagtgcttcctccttgattatgtaatcacaaagaggagaaagacaaatgtttttatctaattgtaatatgatatgattcttccaggtgtatgtgtatgtgcgcatgcatacgtctgtgtgtgtaagtgtgtgcgtcatgtagacacatgaagggaagtgtgacaaattgatgtaagtaatcatttactaagatggtaacatttgaatgggaacttgagatatttgacattccagaaacaacaagcacaccaagtaatggaaagaaagggaggacatttgagacaggggagcagaagatgcaaatgaatagaggtgtgaaagagtttggtgtgttcagggagtcccacaaagtctaatgagactttagtacagtcttgggataagaagggagttgaaaataatgataaatggagctctgaaggtaggttggagccaatttagggattaaattacaatgataattgtaattatcatttattgaacacctagtatgctctaggcactgcgtaaaatgctacatatatgtgtatatatatacacatctgtgtatatatatatatacacgtgtgtgtgtgtatatatatatataatcatttttaaagcccttttttttgagacagagtctcactttgtcactcaggctggagtgcagtggcacgatcttggctcactgcaacctctgcctcctggggtcaagcaactcttgtgcctcagccaggtacgaccatgcccagcgaatttttgtatttttagtagagacggggtttcaccatgttggccaggctggtctcgaactcctgacctcaggtgatctgcccacctctgcctcccaaagtgctggcattataggcatgagccactgttccaggctaaaaagctttttatcaatcatatgagctataagaaatattattatccctatttaataagtgaggaaactgaggcaaagattaaataagtgttcaaaatcaccagctggaaatggtagagccaaggcataaacctaggtctataggaccgcagagtcaatgaacatgaatgaatgaggcattgccaatggtgaggtgaaaatagagcagagagattagactctgaggcatcctctgagatagaaagatagtgttaatgtggcctggtaacttgtttggtgttgaaggctagagtagaggcatggagtatggagggtgactctaaggtttctaatttgcgagatgtcataatctcattagcagagatggaaaatttaggaggggaagagtggtagtgggagcattaatacatttggatttgtatgttttataaacttcaatatctgaaatggactgaaggtagtcactagacttataaatacaagtcgaaaggtctggacagaatatagagacctgggaccacagcatttgggcaatagtaggaggtgtgattatggataaaattacccagggggaatgtataaagttagaagagcatcagggatggagtacttctttctctgaaacattttacattctccttgtgaaatagcataagcttcctagtgttatgtagttttttttaaacctctctgatctctatcaaattatcagctacttgaggacagagacctccttgatgaatttctacaaactagccaacatttagcaaagagccttgtgcatagtgtgaattctttttattggattgtcccttagcatgggggtgttagggatgggactctgaagtacctgtgagaggctttgggttgtcagctaggagctggggtgagagctatacattgggagcaatggaggtgagaagaaggtgcctaccactcagaggttgggctgttttccccatttaaatgtggcaatatagttatgtcaaaaagtataaatgttgtgttttatcaagtaaatattcttaggcttgctgttggataaaatttggtggagtcagggggaaatccttcaacttatgctttaaatttctgaaggaaacttccaaatgtagtaaaataacaatctgagcttgtattcatttttaaatttaggaaaaatatttcaatcatgcat

SEQ ID NO: 970 - DNA, 97077 bp, mus musculus; identical to SEQ ID NO: 969

SEQ ID NO: 971 - DNA, 97077 bp, mus musculus; identical to SEQ ID NO: 969

SEQ ID NO: 972 - DNA, 97077 bp, mus musculus; identical to SEQ ID NO: 969

SEQ ID NO: 973 - DNA, 194 bp, mus musculus
cagaccccgcactggccacgggggaagaacggagccaccttcctcggccagcccctggctccaggaaggggggggtcgagcaacgcgccgttcgggtcggagagcgaaagatttcgctcctgctctgtgtgactctcatccccgttttagcctcagtgtatgttgtgggggggcaaagggtcttgcatgcggtg

SEQ ID NO: 974 - DNA, 194 bp, mus musculus; identical to SEQ ID NO: 973

SEQ ID NO: 975 - DNA, 71915 bp, mus musculus
ctgagcccagcagcctgatcccagcaccccccgccacctccctcctcccgcttcgcccgcttccccggcggcgtggagaagagcaaagttgcgacagcggccgggggctctgcccaggtaaagggggcgccgtgaggcgggggtggtgggggaacggtgcggccctgcggcgggggcggggggaggataaagaaacttgcttcccgcggcccccaccccgcgtgggttccgatcttgcgtggaacgagcccgcgtggcgagtcgcggcaacactgccgggaccgaggccggcacctggacccggacccggaccgcgcgcttgggccggctcggcgggcgcaggcagcgggccaggccagcacccaggcaagggcggggtgggtggccgtacaccggaccgaatcggggactccggtggcgtgggcgcgggccgaaccccgaccgggccgagttgggtggcgaagtaggacgtggattcgggggcggggcgcggcgggagggggaaaccaggcctggccagactggcctgggcgtgggggcggggggcgagttcggggcacttgctgggctctggaccgagcggtagggcggggcggcgctaggggctgggccggacccgcagggagagggcgaggggagggagagccgggggtggagtaggggcgtggagttgtgagcggggtctggcctcggccgggggcgaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgctggagtctgcatagggcagagtggagggagttccacaagacatgatggctgcaccaaaaacactcatgtgggtctggctattttgatttgccaggaaagcgtagataaagagggaggatccctttctcagtgacatagacattcttgggaagaaaagaggggtcctccacagggctctgcttcatttatgatgcagttcatgaaatagaaaaaaatgggccgggtgcagtggctcactcctgtaaccccagcagtttgggaggccaaggcaggcagatcacttgaggtcaggagttcaagaccagcctggccaacatggtgaaaccccgtttctactaaaatcacaaaaattagccaggtgtggtggggcgtgcctgtaatcctagctacttgggaggtggaggcacaagaattgcttgaacctgggaggtggaggttgcagtgtgccaagatcgtgccactgcactccagcctgggcaacagagcgagagtccatctcaaaaacaaaaacaaaaaaacaaaaaaacaaaaaaagaaaaaagaaaaaaatgttcagtacagggagtggaggatctcaggacactattggttggattatgggttgtagggaagggcttctttgagagaaacagaattatgggaaaaaaggacttggacactagagggaaggaaggcaagaaagagaagtcaggaagagggctggttgagcaatgaaaggaaaagaaaggtgatcatcactggtcccatgtaagggccagctaaggaaaaagtcaaaccttgaaatctctaggacaatgttttccaaagtaaactttgaagaactcttaaagctctttacaatttcatgctggaatcactaaggttggggcaagagagaaggaatatatggggtaaaagtagggtgggggagaaactggcatttagagagaaatacaagcatatttatccataaggaaatagggaacttagagattatatacaggttaaaatgcagaatgtgagagaaaaagagaggaattaagagccaaaggaggaagatatttactcagatatcttttggagccggtgttagggagcggaaaatcttgcctttgatagccactgccctgagagggcccaggaagcagaggttagctgggatccaggccttacacatctaaacattaattagaaaatctagactaaagtaaggatactgaatggggggagggattcactgtcctaaatagagtggccttgaaagaaggaaaaagtgggaatccaccagtgtttccagtctgcaggtgggaaggatcctaggtatcaggagatgagtgatggaaattccagggtgaaactggataaaaaactgagtgacatgagagcctgtgggccagaattggagggtggggttaggggcatggaagagaggctctaatcagggcttggactggaggccacatggagtaattcattgattctgggctgagctaagcttgggatgaaatagaacagccaaagagagtagagagctgttcttcagggccaatcagcatcagaatcagagtgaagaaattcgaggtcaagtttgggtgggaaagtgaacaccggagtggaacagagagggtgctggagaaagtgacacaattgttggggtagaataggaaaaggtagaagccactgatgattacataacccagagggaagaccctaggcctttgagttttcaaagagaagggaagtttcttaatgctggagtttgaattaggtgtgagtccatggttgccagagtgtttagtgtcaggatggccaaagagggaggtaatatctacttttcggccactaggatgctagtacagtatttgatataattttacatatgaactaggctttattaatgcccatttttgaatggttatccttaaaataatgtagaaatggttctttttctaaattaaatcattccctttcccactgttcataacttaaaagcaatcttttatgatgagaactttctttggcgaactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctagggaacatttcgggccatgggtgacatttttaaaaaccattgctttctgaaaagggctgttgtgtttatttaattaattaatttatttgtttatttattgattgatttatttgaaaccgagcctcactctgttgcccaggttagagtgcagtggcgtgatctcggcttactgcaacctccgcctcctgggttcaagcgattcttctgcctcagcctcccgtgtagctgggactataggtgtgagccaccatgcctggctaatttttgtatttatattatttatttattttttgagatagagtttcgttcttgttgcccaggctggagtgcagtgatgcaatcttggctcactgcaacctccttctccttgtttcaagtgattctcctgcctcagccttctgagtagctgggattataggcacccaccaccacgcctggctgatttttgtattttttctagtagagatggggttttgccatgttggcctggctggtctcgaactcctgacctcaagtgatccggctgccttggcctcccaaagtgttgggattacaggtgtgagccactgcgcctagtctatttatttatttttgagacagggtctggctctgttgcctcagcctcctgagtagctgggacaggccaccatgcccggacaattgtttttatttttatttttagtagaggcagggtctccctgtgttgcccaggctgttcttaaactcctgagctccagcattcctcctgtcttaacttcccaaagtgctgggattacaggtgtgagccactgtgcccggcagaaaatattcttttttttttttttttttttttttgagacagagtcttgctctgctgcccaggctggagtgcagtggtgcgatctcggctcactgcaacctccatctcccgggttcaagcaattctcctgcctcagcctcctgagtagctgggattgcaggcgcccgccaccatgcccagctaatttttttttttttgtatttttagtagagacggggtttcaccatgttggtcaggttggtctcgaacccctgacctcgtgatccatccacctcggcctcccaaagtgctgggattacaggcgtgagccaccgtgcctggcgctttttatttttatttttgtttctgagatggagtcttgctctattgcccacgctgaagtagagtggtgcaaactcagctcactgcagcttcgacctcccgagctcaagtgatcttcccacttcatcctcccaagtagctaggaccacaggcccataccaccaggcacagctgatttttaaaataatttttgggccaggcacagtcgtcacgcctataatcccaccactttgggaggccgaggctagcagatcacttgagcctaggagttcaagaccagcctgggcaatgtagcgagaccctgtctctacaaaataatacaaaaattacctgggcttggtggcgccaggtgtggtggcatgtgtctatagtcccagctacttgggaagctgaggtgggagggccacttgagcccgggagtgccgctacagtgagctgtgattgtgccagtgcacttcagcccaggtgacagagttgagacccagtcttaaaataacaacaacaaactctttgagctaatactgtttaatgaaagctgtatagatacacctttgaatgaataatatatataaaattagttgaacccatagctgagtctgttctgttgtgagaaaatagaaagaataacctgataatggtctctccaaatatttgtgttatgtagtccaggagacttttataaaagcaaaagttgggtgaggaagaattgtcttttttaaaaccatatatatatatttagagaccgggttatgagactggctaatttttgtattttttgtagagacggggtttcaccatgttgccaaggctggtctggaactcctgggcttaagtgatctgtctgcctcggcctctcagtgttgggattacaggtgtgagccagtgcgcccagctaggaattgtctttaggtgaaaaattgcgtatcatgaatatagtatactgaaatggagacaccagagggccactgtcacagtctatggcaggcaggacccagaagcatctcaaaagggattcagaatgtctcatattacaatgattcaagtttagagtgtgaaaaacacactaaatatttatatggtcctgctgaagaccaagattgagggaagccaatttgtgtttttgttctagcggaaattagaagtactcaaaaaatgaccctagatatttagggtgacattttgaggttgctttgccttttgaaaggactgattaatttcacaatgatcacttaagttttgcgtgacatctagaagttgtataaaatcttgtagctagagccgaggtttattataaagctatgatgaggtgtttttgttaaatggagtaaagtaattttcttacagcaggaaatggaagtgagtactgtttgaataataagaaaaaagtatcatagcaatgggtagaaagcaaaaagaatctggcggtatgaaaatgtaagtgaggccaggcacgctggctcacgcctataatctcagcactttgggaggcaaaggcaggaggactgcttgaggccaggagtttgagaccagcctaggcaacatagggagaccctgactgtactgaaaaaaattttaaattagccaggtatggtggtgcacacctgtggtcccagctgcttgagaggctgaggtaggaggattgcttgagcctgggaggtcaaggttgcagtgagctatgatcatgcgattgtactccagcctgggttacagagcaagacccgtctcaaagaaagaaataaaatgtaagcaaaagattaaagcttttgcatttgactacttcattcttggaatagattacgtatggtccttttttttattttttaatttttattttatttatttatttttttgagatagagtcttgcttttgtagctcaggttggtgtgcaatggcacaatctcagctctgaccccccaggtccaagcgattctgctgcctcagcctcccgagtagctgggattacagatgcccccccaccatgcccagctaattttttgtgtttttagtggagacagggtttcaccatgttggccaggctggtcttgaactcctgacctcaggtgatcgcctgccttggcttcccaaagtgctgggattacaggcgtgagccaccatgtccggccagtctatggtccttttctaagtgctttcatgttattccaaatttttagtagggactagtagtttattcccattttgcaggtgacatggtaaatggacatagagagatagtctgagatggctgagaagtggggactgggagtgttctccaagttttcccaccgcagtgtaggctatgggtgctagagtatatcacttttcaaggcattacttgattagatggttctgtttaatattgctgctgtttgagtagattgttctgaatggattttggatgttcctaaacatcagatcgaccctgaaaggatgggttccagcactaatgaggagagtgaaaaggacgtagtattggtctggatgctaacgctcacagaggaactccagggagattgcaagccctggccgctcggctgagatgactgtccagcctcctgaggcgactactttggggtaactacattcatttgaatgataaacgctcatgtgtttaacagcagttaacattcctttgtatccagtctcataaatgtttataggtaaggttttagacatggaagtacccaaagagtctatgaaggggtccatgctagacctatatgccggcaactacctagccttcccactaaataccagaattaatgtatctgggcaaaagatacaatatgccttataagactgatcccttggggtagatatcagtggaaatatttggataggaaaaaaaaaatccaggggaagtagaaagtgttagaatagatttttagtcaggcagaagtttgggatgaacagcagaaagggctgttctttctcctttaaattgcctggcagattatttctagttgattttgtgtgtgcagtagtagaggaaccaacttggcatgaagagaagcaaagtaaagtgtttgggggcatgtctatgggacttcttttttttttttccaagacagagtctcgctctgttgctcaggctagactgcagtggcatgatcttggctcactgcaacttctgcctcccaggttcaagcgattctcctgcctcggcctcctgagtagctgggattacaggtgcccaccactaggcctgactaatttttgtatttttagtagagatggggtttcaccatgtggaccaggatggtctcgaactcctgacctcaagttatccacctaccttggcctcccaaagtgctgggattacaggcatgagccaccacgtctggcctctctatgggactcttgagtttcagggaatatttggttaatggtagggaaagatgagggaatatagatattgggggtaaagattgaggagaattttcgaatacccttatatgtattagatcattaaataagtttatttttatttttattttttgacacggagtctagctctgtcacccaggctggagtgtagtggcctcatcttggctcactgcaacctttgcctcccaggttcaagtgattcccctgcctcagcctcccgagtagctgggattacaggcgcacaccaccatgcccagctaattttgtatttttagtagagatggggtttcggcatgttggccaggctggtcttgaactccagacctctagtgatccacctgcctctgcctctcaaaatgctgggattacaggcctgagccactacacccggccagaacggtttaaattggggtaacttcctcattgggggcaggggttgtggtatgtaatgaagtagggaaaacaggaatgttagtctcctaacacattctgttgaatacacatggaagaaggcagagtaatcaggagggcaagctctgtagtaggagttccacatctaaagccgggtaaagttgtccttgctgggtgtgtgtacattttcctatggaaaacaatgagcagatttgccttcactctaaaagacttctgggcagaagtcatggccttttccctttagccctgagatctcagtgtcagtggtctcttagatctcctcaggggtgtcttagatgctgttttttcccaagtggaatgatgaggtggcctctccttttgctgctgtaaagtttgcctctgtcttatgggagctttaccaagagctctgggtctctattggaggagtaggtcccaaagttggttttccttacttattagtcatcactgacccagccctcctccttaaactgtctgctggccacgcctatcctctagaggacagattcagggccaggcttcaagatgaatattttccggctctttcattttttaaagtcataattgcttccaggtcaccaggcagtatgaaccaaaaggagcctgggggagcaggactacatttcgtttaactgagagcttcttaagcttgggtttctagtttactgtcttgatggtagagtccaagcatgaataaatgggtaggtttcatgctatgtgtagaagaccgagttgtgttccataagttgagtgttctgcacttaaggggtcttcagccacaaagggaactacatgatcctgaagtacttgtcagctgcatgaacatcctgatcattttcttttatttatttattttttgagacaggatctctctttgtcacccaggctagagtacggtggcgtgatcttagctcactgtgggcttgacatcctgggctcgaaggatcccttctgccacagcctcctgagtagctgggaccacaggtgtgcaccatcacacccagctatttttttattttttatagagacgaggtctcactatgttgcccaggctggtctcaaactcctgggctcaagcagtcctcctgcctcagcctcctaaagtgctggggttatggacatgagcccatgcctggcctggtcctttttaaggttaaaaacctcgtaaacagtgcctacctcagtcaaaaacatttgtcagatagatgctttctctgttacctcctttaatgtccttctcttcctcatatgcatgatgacaaccatgcttttgcttgtaattgttgtgaaatctgcatgttttggcatcttcatttcaaaacgaaacaaaaaaatcctatcccacctgtaaaatctcctttgagattttggtgctgcctatcctctattactaactcccccagccccgacataggctataatttgatgttattcttccccttttgagaacacattctctctaaacttttctaaaatgtctgtcttcagtgcttccccacagtgtttcagtttggcccatgatggtgaaatatttcaggttcccctatttcattttttttccttttggttattgcatgcgatgggcttttcttttatgcctatcacacctgcccttgtcttctagtgtgttctatttggattgttttaaagatctctgcttcattatggtttctcttccactacccgctcgccctcagcttagctgctatttttcaccattttaaagttattgcggccaggcacggtggctcactcctgtaatcccagtacttttggaagccaaggtgggcggatcggaaggtcaggagttcgagacgagcctggccaacatggtgaaaccccgtctctactaaaaatacaaaaattagccgggcatggtggcccatgcctgtaatcccagctactcaggaggctgagacaggagaatcgcttgaacccaggaggcggaggttgcagtgagccaacatcgcgccattgcactccagccttggtgacagagcgagactccgactcaccaaaaaaaaaaaaaaaaaaaaaaagttattgctctctcattagttccttttctttttggtttcccctgttctgtagtgtggtgattgtctctggctacctactcttggctgcccacctgttggattcatttcctgggatcttgggtaggccttttacttctctgtgcatgtgcctcctaaattgaagttttacatatatatatatatatatatgtatttttttttcccagccacacttatggctttggattggcagagcacgtgctctcctttgtcctcaccatgagttggatatatcttttgagttttttcccccaaagtagggatagctcacagtggttcctctgccttccaggcagtgaccagggttgattcttgggccatgcagctgttcatttctttaacaattacatggttgtgacatctgggaaaatcctttgaggtatttcatatccttgtgcctgtgcttcctgggtcatttgggattaccaggtttcttccaagttcctttttggaactttgcttttgatgtgatgatttccatcagagagagggagagtaggcggggtggtggggggaggtgggaagggagaacacatgagtaccggtgcttcaagcaaaagcaagccagcatacaagtgtgtaaaccagcagcgcttacgaagtgtggcatgcctgcaaggcttttcctttttgctcacctctcctgggatactaatttgattggctataatataataaaacaaacccctaggcctactgaatcagaatctccaggactgagacctaggaatctgtattttgaacaagctcctcggtgattctggctggggaaacattggttgacattgaccgtcctgactcctcccttctgtgagcattcacgcagtcaggagtctgttctctagggccgctttagaggttccctttgctttccctctggctggggaagaccaatcttgccttcttgtatagaccatgtagctcagtgtcagtgttctcctgcctgtgttttatccctcccctcctctcctctcatctgcagaggctactgttaattagcaacagtgggcttcagataggaagtggcgctcctgggacaaaatcatgatagaaaattgagaggcaaagatttaagtggatgctccatcttgaggatcttgtgaaaatggagttatccagaatcagcgttgctctctacgtggtcataacatgtgtattatatagtaattattttgatattttaactcggttttattttttgtggttttttttttttttttgcctgaaagctctttatctaggtgatgttgtatgatgttctgtttccaaatgccagtgttccccctctgatttctgtcccagaccctacatactactaatcctaatcctctctaaatagagcaatacgaaacctgagagtgaaaaatctagtgtcactaatacctgctgcctatagatatttagtagcaactaaaacttgtactttgtgttgaaacacatctttttttttttttttttttttttttttttgagatagggtctccctctgttgcccaggctggagtgcagtggcgccatctcggctcactgcaacctctgcctcccgggctcaagcagttctcccacctcagcttcccaagtagcagggaccacaggtttgcacagccacacacggctatttttttgtattttgtagacatggggctttgccatgttgcccaggctgatcttgaactcctgagctcaagtgatccacctgccttggcctcccaaggtgctgggattacaggcgtgattacagtgggattacaggccactgctctgggcctgaaatgcattttatggcaagaacagccccttccattgcttgagtcctctaattctttttccccccccccagacagagtcttaactgtcgcctaggctggagtgcagtggtgcgatcttggctcactgcaacctctgcctcccgggttcaagcaattttcctgcatcagcctccgagtagctgagattacaggtgcctgccaccacgctcggctattttttgtatttttagtagagatggggtttcaccatgttggccaggctggtctcgaactcctgacctcaggtgatccacccgtctcggcctcccaaagtgctgggattacaggtgtgagccaccatgcctggccgagtcctctaatgcttagtagagagaaaagatgaaatgagtacctggggtatcagccaataggctgagctggttttgtttttgtttttgttttagacaggattttgctgtcgcccaggctggaatgcagtggcacaatctcagctcactgcagccttgacctcctaggctcaggtgatcctcccacctcagcctcccaagtagctgggaatacaggcacccgccaccatgcccggctaattttttgtagagatggggtttcgccatgttgcccaggctggtcttgaactcctggactcaagcaatcctcccagctcaacctcccaaagttctgggattacaggtgtgagccactgtgcccaaccagtgttgttggttaaaatggggatattccaagatattctgagaaacagtcaaaacttgattaaccaggatgttcagggaacggggtccttgttaaaaatatttctaaaattatgctaacccacataactgtcttcataatgttaaaagataattgtcagaaaaaaggtaaaaaatcatgactctcgtacagatacaaaaatgaacacgtgttaaagattttattttactcattaatcaacaagagaaccagacagatgttatagctggttcaaacaaaaagtcaaaaagcacaaatttatatggagtaaaggaaataaattgcaaatggaggcaaaagtagtttttctacagtggggaggaaagacaatccaaactcaatgggacaagacagacttcgcatatacatcagttacctgcaattacagagatgcaaaatagcttgaagacaataacctgagctaaaatcagatagcccagaaggttatgctatagacagtgcatagttttttcattggagtacaaaggtttttctgtagtaagcaaacatggtggatgctttgtgtgtgtgtgtgtgtgtgtgtgtgtgtgtgtcggggggtggctgttgattttgcttcttgtgatttctcagggccgtcacttcagttcttatccagaattcagttccatataacatgcatttactgagtagttactatacgtaaggtgtcgtggaggaaacaaagacaaaaaaggatgctttttttttctttttcttttttttgtttttgagatggagttccacccttgttgcccaggctggagtgcaatggtgcgatcttggctcacctcaacctccgcctcccaggttcaagcaattctcctgcctcagcctcccaagtagctgggattataggcatgtgccaccatgcccggctaatttggtattttaatagagatggggtttccccatgttggctatgctgatctcaaactcctgacctcaggtgatctgcccaccttggcctcccgaagtgctgggattacaggtgtgagccaccgtggctggccaaggacgctatttcttaccttaggtagctgattggtgggggagacaaacatgccttgtccccaactaaccaagctagagaggagaataagaaccagtgctgtggaagaggtagggagtaaatacttgaggacaaccagagagggaggggttaactgaactcgggctggggctagggggatgacatgatgacatttaagctgagtcttgagagaagacagggagaggaagagggggaagcaggagaggccatttcagggtgaggaggcagaagagtcctgaaactggatggtgtgtttaggaagggttgggagctgggggtggtgagagtggtggggaaatggcaggatgtggtggaagaggaggctggagaggaggtttgaggccaggtcatgagggccctgaaggcagtgctgagaatggctggctgggtgctagaggccggggaaagctattgaaagcttttgaggagggaaggagtgacatgatcgaactggcgctttagaagatgaattgattgtagaatcaagaaattgaaggcagagggagcagttaagaggtgattataatattctgggtgagagctgatgagggcctgcaccagggtagtggcaagaagggtagaaggcaaggctggagatggcattattaaggcctgacttctgatcgaatatgggcggcaggggagagaaggagttgaagatgacaaggcggaaatttccaggctaggggacggtagtgccgttaagtaagctaggaaacacgctgcttactgggcatagggggtggggagcaggtttatgagaacagataatgagtatggtttgagacacattgagtttgaggggcttggtggtcatccaattaacagcaagttgctggcagctggaaattctggtctgggcctaaggagagaggtcaaggctagagatacagatttgggagtcatcagtgcatcaaggggcgagctgaaactgtggaagctcatgagctgagagagaaggtggggcagggctgacaactggcacagagggagagagatgggtgggggaagccagagagagccagcaaaaggcagactaggaggaaaagagacagagggagaccggggagggaccggaagagggagactgaaggccaaagagtagaggggagggggaggcacaggggagggagaaggggaaggagggggagagggaggagagaatgaatgggagactgagggaaatggggaaggtgagataagcaagaaaaagacagggaaggagagaggtgggaacggggagaaagttggaggagaggggattgtgtgtgtgtgtgagagagaggagaaaggcaagaggtgaacagctgggaaaataataggggagagaaaggtgaggaggaggaagagtaaagagagagagatgggtagggggatgagaaagagggaagaagccttgaaagataggaaggggaggaaatgggagagggtggcagaggtgaagagagacagagatcaagggaaaggccaggccccagtgaatgcccaagtctttggggtgggcagtggaagagaagggccccggagaagccatcaggcagtggatcaggaaagacaagagaagggagagaataaagagggcaacgtatcccactctgcagagatgaggaggaggatgaagcccaggcagggtggatgcctctctcctctcttctcctaccacctccacactggtctcctggctctcccttgatctttgtgggcaacctcctgccttaggactttctcatgcactgttccctcagcctggaatgcttttctcccaaatatccacgtggctactcctttacctcattccgatggtttaaatgtctcctttacagcaaggcctatcctgttcaccgtatttcagatagtagccctccccacctagactgtgcccttgccccttagtctgtgttgtattatctcctcctcctcctccttcttcttcttcttcttcttctttttttttttttttgagacagagtttcactcttgttgcccaggttggagtgcaatggcatggtatcagctcgccgcaacctctgcctcctgggttcaagcaattctcctgccttagcctcctgagtatctgggattacaggcatgtgctaccacggtggctaattttgtgtttttagtagagacagggtttctccatgttggtcaggctggtcttggactcccgaactcaggtgatccacctgcctcggcctcccaaagtgctgggattacaggcatgagccactgcacctggcctgttgtactatcttctaacatgccgtgacatagaactatttaacatgctatgacatagaagtattcaacatgtttattgtccatgtcatccccctgggatgtaagctccacacgggcaggcattttgttctgtttcgttaattgctgaatcctcagtacctaggatggtgctggctcatagtaggaatgcaataaattgtgatactgtgttgaaagtggacaatctctgaaaattgaaaaatggatacatgaaacaaatccctcgtacaactatatcttattgtgatttactttggaaagtggagaacagcattcaattctgatcactgtagggttctgttcagttgaacttcaatgaataaggattttagctaataagctaactcaagagcttaagggtctcaaggcaagctcattggataaaggtttttcttggtgcctcattttttctagaaggtaaattaactgtgccctgcttgtcaaagcgagagagggacattggctggtgaagagagtggtggaacatggagacaacagactgacaggaagggacaaggacagaaatgtgtggtttttttttttttttttttttgagacagagtcttgctctgtggcccaggctggagtgcgctggcatgatctcagctcactgcaacctctgcctcttgggttcaagcgattcttgtgcctcaacctcccgagtagctgggattacaggtgcacaccaccaccccaggctaatttttttatttttagtagaaacggggtttcaccatgttgtccaggctggtctcgagctcctgacctcaggtgatccacccgcctcggcctcccaaaatgttgggattacaggcgtgagccaccgcgccctgccgaaacacgtagttctggatggaacgttgttttctgtttgtttgcttgttggtggtcagcgtgcaaggagtactgcacctgatttggagggagcttgaaaccaggttagatacgtgtgttatttccaactcaaagtcaatggagtatttttgaaggacttacgaaaaaaagcatgtgcttcctctgaagagtgtaaattggctacgtcactcaaatacttcagtacccatggattagagagtagacgagaaaaaggtcaccagtagtgttttagtgcaccattcatatatgggtatgactctctaattgtagttggttaggctaaatgtgtgtagaaatatatactgtcatctcatttgtctgaaatagattgaatttcctctactcaagcatatctgtcttttaagataatttaaaactcactctaggtgattaacaatgtcctcatctccatcctgaaacctatggattcctagaaagctggtgctccctcttcccggtttagaccttaattttccatagcaggctggctgctttaacattctgatgctgtaattacctttattgaaacattgctgtgtaaaaggtgattgaagcagctgtccctgttacgagttttgattttctggaattcttttccccagggggagtggccacagcaggtcctatctggtggtgagtggctgtcatgatctctacagcaccgctctacagcggcgtgcacaactggaccagttctgaccggattcgcatgtgtggcatcaacgaggagaggtgaggaggccaggaaggtggccgctgctggcctccagtgagcagtacctcgtcaccagagggatagctgcatacaatagggcctggggagggaccctggggaggagaagactcttagttgtttctaattttcctgtggtgggatggggatggggctgtgtgagtggcctgatctgccatgctatctcttttcagatgaaggtgaggaggccaaaaaaatgaccttttgccagctagcacttgtctactcattaacaactgtcagactgtggagtaaggggaagctcaggcaatggcaattttttttttgttttttgagacagagcctcgctttgtcatgcaggctggagggcagtggcacaatcttggcccactgcaacctccgcctcctgggctcaagtgattctcccacctcagccccaccagtagctgggaccacatgcaagcaacaccacgcccggctaatttttttttttttttgtagttttttagagacgggggtttcgccatgtggcccgggctggtcttgaacccctgagctcaagtgatctgcctgcctcagcctccccaaatgctgggattacaggtgtgagccactgcccatgcctggccagcgattgcagtttttatttgctgcatcaaagtttggtgctcaaggatatgtgtaaggtattttcagtctttgatctaggtctggaagaaagatggttttattgttcagatttctactgggaactggcagtgggcattctggtggtcagcgctttctcacctcatgaggctaattctgatttgaagtgagatccttatgaagtatcaaaggaagttgagaccgcctagcatagtcttgagagttggtgacacctgcctcacgtgtgtattttcagttatctgttccccagaatatttggttgaccaagatgtgccattgcctgatcatgccccatacccaaagcactcaaaatggccttcagaatttatatttggctttcataacccttggtcaaagagctgtgtgtgatggctgcagtgcctctctcattttctttttttttttttttgaggtggagtctcactctgtcgcccaggctggagtgcagtggcgcgatctcggctcactgcaagctctgcctcccgggttcacgccattctcctgcctcagcctcccgagtagctgggactacaggtgccgccaccaagcccggctaattttttgtatttttagtagagacggggtttcaccatgttagccaggatggtctcaatctcctgacctcgtgatccgcccgcctcggcctcccaaagtgctgggattacaggtgtgagccaccttgcccggccgtttttattttttatttattgatttatttattttgagacagagtctggggctacaggcgtatgccaccacacctggccaatttttgtatttttagtagagacggagttttactatgttggccaggctggtctcgaactcctgacctcatgatccactcacctcggcctcccaaagtgctgggattacaggtgtgagccactgcactcggccgcctctctcatttttagagaaggcactgctccttcatgcttgctggtgtttttttgttgtttcaatccattgactgtttaaattcaaatatacatcagataaatcaccaagacacagaacaatatggctttccctgggattcaagatctgacgtttcttgggtaaatcttagaaatgtgtgtgcgcatataggggagtattggtaatttgaagggaaaaggaatggaagtctttgtgtttatctactttgttcttctgttcctaactggagaagtatatacttgtctgaggtcaaggttagcagaatagacctttttattttcttaagccattagtgcctgatagcttaatgttctctgtactgaggaacaagttagagatgggcttaaaaggaatttaattttaggataaaaagagtcaagaccatggaaaatgagatgaaattcttaggtgctcaggaagaaaagtgttttcctttacatatgaagcatgtcctcagatgatcactaagagatgatctagggaaaggcagggtgatgataatgatttgcgtaagtattcattggcaggtcatgttgacctagttataagtagttgagactttgatgcagaaatctggactagagccttcaaaagaccagcggggccgggtgctgtggcttatgcctgtaatcccagcactttgggaggccgaggcgggtggatcacctgaggtcaggagttcaagaccagcctggccaacatggcgaaaccccgtctctactaaaaatacaaaaaaattagccaggcatggtggtgtatgcctgtaatcccagctactggggagactgaggcaagacaatcagttgaacccgagaggtggaggttgcagtgagccgagattgcaccactgcactccaaccggggtgacagagcaggactccgtctcaaaaacaataaaattaaataataataataaaagaggccaatagacaagttaccttagttcaccatctactgtaaatccctgccaagaaaggagcaggaagtaggctcaaaatctgattttccctccatcttgttttttgtttttgagatggagtcttgctctgttgctcaggctggagtgtagtggcacgatctcggctcactgcaacctccgctgcctgggttcaagtgattctcgtgcatcagcctcctgagtaactaggattacaggtgtgcaccaccatgcctggctaatttttgtatttttagtagagacagggtttcaccatgtcacccaggctggtctcaaactcctgatctcagtctgtctgccttggcctccaaaagtgctgggattacaggtgtgagccactgcacccagccagattttccttccttctaaacctgtgcctagtgcttaagaggacattttttttttttttttgagacagagtttagctcttgttgcccaggctggagtgcaatggtgagatctgagctcaccgcaacctccgcctcccgggttcaaacgattctcctgcctcagcctcccgagtagctgggattacaggcatgcgccaccacacccggctaattttgtatttttagtagagacgggttttctccatgttggtcatgctggtctcgaactcccgacctctggtgatccacctgcctcagcctcccaaagtgttgagattacagatgtgagccaccacgcccggcctaagatgaccttttaagtgttgtcacttttgatctcatccaccctttattgtcaccttcttgctacagtctaggccgctacagcctagaccatgctatcactggtttccaaaatgtaatctcaccttatttaaaaatcattttccttggccctttacaacttgtagaatttaggaatttggggtacaaagctgtgcctggggttcaactcttaaagtgatgttttagaggcctgccagctttggcagctgcaattgaggactgtagaacaggaggcatgggcttgcggctggccccaggtggccgtctctaggcaaacctacagctaaatgtgtctgcttgcctgcttgcatcccttctaggattaattcatgccttcattcaacaaacatttattcaacataatgagagcaaaccagtagttctagtacattggtggtgagtgccctagaattgcatgtccgggtccagtgggagtccaaatgcaagattgacaaacctcctggtgggagaataaggaaaggcttcccagaggcagtggcatttgagcccaggcttgaggaatgagtaggagtttgaggtgagagctggtatttccctgagacaataagagcacagtgtggctgggcacggtgactcacgcctataatcccagcactttgggaggccgaggcaggtggatcacctgaggtcgggagttcgagaccagcctgaccaacacggagaaaccccgtctctactaaaaacacaaaacttagctgggcgtggtggcgcatgcctgtaatcccagctactcgggaggctcaggcgtgagcccgggaggcagaggttgcagtgagctgagatcgcaccattgcactcctccagcctgggcaacaagagagaaactctgtctaaaagaaagaaaaaaaaaaaaaaaaagcacagtgtgtttggggaaggtccaagttggaatgaaggcaatcttggggtactgtgggactcgaaccagggaaagtctcccaggactggaaggtaaggagcctggtgtgtgctgggtggtatatttctcttacgggtagtctgggcccagcaggaactgaagagggtccggtttgacagtggtgctagcccttaataattagggaaatggcccagaggggtcatggccatttctggtttaagttccacaaagccttgaacataacagctctgcctcctctgtggtgggaagaaacagcaggattgattttcagtcctgactgaagcctgctatgacctctgttccctcctgccgcccgcctccgccagctgcaccctcataaccttgcctggttgacccagctcttcccgggccccctcccctgcaagttactcctgtcccaggctcttctctcaatggagcaagttaatgtttgcttagctctgcccacccctcttctcagaggatttgaaacacggctgcatgacattttgcagcgccttcggggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctgaaaacacaacaggggtttatttgttttagaagaggattacccatatgacactttcagccagctgcccttagagacttaaaataagattgtatttaaaagaaaaatgggttttgcatgccttttgaggcattcagtggttctcatgtctcccctttgagcaatgccctgtacatcctggatggtcattttggcaggtaagctccagggaaaaggtaaaagtgctagggtgtccacactcctggcaagagccctagaaaacagggtaaacagtccaaagaggggggtctagtcagactgggctctggtagggacttgcaaagctaggtgtggcgcctccgctttgtaaccaagaacccccagttccttgtaatccccctcacaagttactacaggaagtgaggtaggaaggttttatggggacccaggcaggcaggaggcattctggggaaggtggtgttggctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtaagaggctttatggagccacgtgctgtccaccaaaggatggagctgagctgcctgggaggtgtgcccagcctgccatcccaggaagtgggcaggaagggacagggtctctcccaggagttggtattggtgggacacaaattggctggctgccctctgcgtcttccgagacctggttggtcgagttgcagagaagaccagcagttgcctctcgggcctcaggacacttgcaccatctgcagggagctggctgagatgtgcatgctatcctgtcgttgcaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaaggtgagtgctgagctaaggtccagggtggggccgagatgccgctggtctacttcgtgccatggatagcaacctcctgtgacccctaccctgtgacacagtgctgttgggcagctgtgtgaactgaacggattggaaggcttttgtaaaagtaataatgacctgctgtcccctccctaggtcacattttccatatacggtgtctcagcatggggagaggctggcttgtagtttgtaggatgtgggaaatgattctgtccctggggtagggaagccattgtcccagatgagatcggaaagcggaagaaggtattggtgagggaaatcaatgaataacaggctcttccttgaataaccattcttccttttcctttactgagagaacactggccttgagaacttagggatggggagagcaggggcctctgacggggttgttcctttcaccactggttggggggcctgcttaggatttgctgggagccttgtggggtcagagccaatttggcttctgtgctaatcagtttcctacccgctcgaatgcttgaggcagcagctttgggttttggcccactggggattggatgggcaaggcaggttgggtgtctgggtgttggtcttgacaggctatggatggtggcagagttctaggcaaaaaggtgggccaggagcacttgatgagaatcccctggtcccccagaagggaccagaggctactggtgatccaaggagaatcttgaaacatttgaggatagggtttattaaaaatctagaacaacttgaagttctgttagcaagctttcaagttggatgttcatgtacactaagggacaaaatttctggctagagcactgtgaatttggctgtggcacaagtttatggtcttttttggaccatagaccattttgaaaagctggtgagagctatggaccctgttcccagaaatgtgacctcagaattttgccaataattttagggggttcatggacctgacctctgccccatcgcccaaagctcacccagggactgcaggttaagaacccctgggataggtgtttgggtggattttaactcacaaacctcacaaccaccctggtatgtcagagacacgtgaagtaggaacgtgggtcatgacgcagtagagcatataacgtttggcaggtaattgccatctgcgctcggtggtaataagaataataattcatgtcgttagagttgtgtttttacatttgttatctaatcgttacagtaaccatatgaggtgaatgctacaccaatctacaggtgagaaaataaatgaaacagaggctcagagaggatacattacccagttacacagctactaacttgcagagctagaactcagactctggtctctggttccaaagtccatgttcttcttcagctataccatattatcttccactctctttttgtttttttttttttgagtcagggtcttgctctgtcacccgggctggagtgcagtggctcgatcacagctcattgcagccttcaccttctgggctcaagcagtctcccactttagcctcccaagtagctgggaccacaggtgtgtaccactacacctggctaattattttttgtagagacgaggtctcactatgttggctaagctggtctcggactcctgggctgaagcgatcctcctgcttcagcctcccaaagtgctgggattacaggcgtgagccacctcacctggccatcttctactctccgcccatggaactgtttcactgaatgttttgcaagtttttgttgcatggctactgtatgccagtccttcccaggcaatgggaatacctcttcaggagggtggtatcatagattgatgaggagtatgctccctggagccagacacggagcctgggtttgaattttggccccacctcttcctagctgtgtgctattagtcaagctacttaatctctatggccttcagtttcttaatctatacacaagacaataatagtatctactcatagagttgtgaagattaaatgagatgatgatataaaatgtccacaataggcaaatccatggagacagaaagtagactagtggttgcctagggttggggaggatggaagagttggggagtgactgtttaatgggtattgggtttccattcagggtgatgaaaaagttctggagctagataagtagggatggttacatagctctatgactatactaaaaacaattgaattttacacttaagtgaattgcatggtatgtcttaataaattgtatctcagtaaagctgtcattttaaaaaagattaaagaacgtgatatacataagtgtgtacagtagtatctggcacatagtaggtgttcagttagtgttagtggttgctgttattgttagcattacaaacaaaatagatgtggccccgcctctcatgaagcttatgtctctcagatgactcagtgacaggtgggcactgccctatcctatattagatgaacagttcagtgggcccactatcaaatgcagagggcagaaattaaaatgacaagatcaggggcctggaagcagctctttgcaactgcctgtaaggatttagtaaatgtctattttttgggagtgcaaatcacttcgttccttctttttttttacatgccaccttcctgagaaggaaactgttgatcagcaaactaagatcaggggtttgtttgaaatagcccctttcagggcttggccaagagtgaaaatagtctcctgttgccaataccacctgcccaaggcctctcaggatcctaaagggccttctgcatcaccagcaaagagagagagttctgcttcatttggtgctggatgtattttattgtcctctcattccttggaaagctctttggaaaatatttcaaaactgttaaccagaatgttcatctctcacggtctccccatcctcccaacttcatgcataagttggagtgtgcgaaatatttttattcctgacctcaggtgatccgctggccttggcttcccgaggtgctgggattacaggcttgagccaccgcgccctgctagatgttctgttttacttgtttttgtcttcggaagtaaaagttaatgatctgcatttgaaagagccagctaagaatgatattcagaaataaataggacatgttcaaatgtatgtgcatttgactttattccccctgacttaaaatagtttttctccagccgtacctgaaggttagtttttaagcagtagttcctcatcttcctctttccaaccaatgctttcctcctcctaacactttggtttgtaggaactggcagcaagccaagggggaaactgaacttgaatttttagctcaggcctctgctgaaaataagaagcaggaagagttcatgggataggaggagtcctggaatttgatgggtagtggtgactccctgtccctggagaattaggaggccccagcccccgaaaatgttccatcagtaaggtatgtgccatccccttagctggaggtacaccacgataaccttctagcaggcgaggcatgggtcagcttaggggaaaaacagctcaagcaagtttaacccttcctttcctcctcggacctgcttttattgttccaacgttttgcttattctgcactccctgcatactagaatactggaaatccctacattgccctatttcttgtttagtggcacagagagacctcaaagctcgtgagaatacgtgactgttaggctgagagtgtccttgcagtgtgtgagcacagccattgtgcctcttagatgtgccaggcagtgggcgtgggagaagctgagctgaagcagccgaggaagtgattcagggaagataggtagcgagagctgatgcccagaggcccgggctgggggccagacccccgggtcctagtcccaattctgggtctttctcactgcaagcacaaatgtgctaacttgcgggttggcctggtaagtggcagtccctgagccagtggacacatgggattgtgtgttaccctggacaagtcattcaaccctttgtcttggagcctccgttttcttatctgttcagtggggataatattagcttctcctcccagggttgtggggaggataaaatccaataatagagatgagagcatttggaaaggctgaaagtgctacagagtataaagtggcattatgaataatgcttgggccttttcactgggttttataaatatgaggatatttgaattgctcctgtgtcatgtttttcttcttgccttagttgaatctattttctggtattaatttacacgtgaaaagagacaatttttcttgagttggcctgtactgagaattattttcagttgttggtgcaataccattcacagtgaagttatttgaacaatgtagtctcccaacttgcagaagaggcattttgtttaatgccggtctctccattggtgtttgggtacagagagtatggggcctgactttgcaccttttaaaatgactttgggtgtttattcactggcttttgaacgcagactctgtagacctctttaaagtgatgggatgtggacgcctatggggattagctggggccctggactcagtccaaaagagcccctgtcacccactctggaaggcagtgcacggccccttgcccctggtcccccactctgggcagctcatgcctctaggtcagaaacgggacacatggctcaacccctggagagctttcttaagaagcaaaactgacctcagacctgaccctctacctctccacagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggtaggccccgcggccctggccctctgggctgggctgcagagggatccccagggcacagtggtgagggcagaggggctcaggcgctgactccttcactctggaaaagtgagacttcttcactgtggaaagaagatatgattgacccctctgaagtctaaggtgagcgagcaaggatcgggggccccttctgctcctcctgggtgctagaataaggctgaaggaagtggttttccgacacaaacaccaggcccacaacacagtagccgacccatttccccgcgatgggtctaggctcaaagaaacaagtttaaggagaatttagacaaaaaccacggaatgggggttcattacgctgtcttctttgggtatactggaaaactgctattctgaaaggacaaaaataaatagctagttagctaggagagtttagagaaatcttaaacgtttattatcatttagggacacacaggatatctgggatgacggggctggtatgtgtccctaacctgtccgttttgccactaatagtttctgggcacccttatcagggagagaatccccagcattcctgagcataggagtccaggttcatggtcttgcccacctgacgtgactatgacctgcctcttctggtctgttctttttttttttgagacagagtctcactttgcttcccaggctagagggagttcagtggcacaatatcggttcactgcagcctcaacctcctgagctcaagtgatcctcctacctcagcctcccgagtagctgggaccacaggcatgtgccattacacctggctaatgtttgtagttttgaagagatggggtttcaccatgtttcccaggctggtcttgaactcctgggctcaagccatctccctgcctcagcctcccaaagtgttgggattacaggcgtcagccactgcgtccggcctcatctgttcttagccgttttttctctgttcactggctccttgttcctatcttcccacctcactcaatcctccaagattcactgaggttgccctcctctgggacctgctccagctcagttagaactttgtttattttctttctttctttctttttttttttttttttttttttttttttgagatggagtctcactctgtcacccaggctggagtgcagtggcacaatcttggctcactgcaaactctgcatcccaggttcaagtgattctccttcctcagcctcccaagtatctgggactacaggtgagtgccaccacgcccggcgaatttttgtatttttagtagagtcggggtttcaccatgttggccatgctgggctcgatctcctgacctcaggtgatccacccacctcggcctcccaaagtgctgggattacaggcgtgagccaccatgcccagcagaactttgttgaggtgcagcagcctcagagtcctatgggcagtggggcctcctactttcctactttctggcacaccatcacattgatactgtgcactgccttttctggtatcagcaaaagcgaccaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtccccaaaccacacatcactccaggttccttggaaaagaaagcaaagagcagtttccgtgactttattcctgtggttctgagcacccgcacgcgcagtcagtctggtgagtgagactaaggtgatggcccctctcagcatcttctatgaaaagagagatcgaaatctggttgagcagttttaccatgggcccaggtgtcgagttgggaatttgattcactgtgccacaatgcccagctccttgcagagataagagagccctgggtgggggcaggggacaaatagtcctcaaatattgcccactgtttgaggattatttgttcaacttttcagagcagggatttgacatctcttgttgggagctgatggtggaaagaggtaaggcctgtgccactcgggaaagctggttcaactccaagctttggcacctcgtcattactggggctaatctcaggcacagacatttaactttctaccttggtcttattgccctatgtgacaggcagcctcaaagttggaaaagtcattgaatcgtcagggctggcagaatcacatttggctccctgaatttgtgttggtcaacctctagggactaaaaaaagctagccctttctagccaccactaccttctgctagcctccacactggtatccagggctggagatagttgtcccagttcacccaatttccatgcaaattggatagaatggggaagcaaggtatagtgtaaactcagttatctgacattctagtaaccggcaccttagcacatggcaagcgaggtggtaattggggctcataatgatggcctggaggccttacaaaatcctgaagtgtcctctgaattatcaaagagcaattacattacagccagtcccattttagtgttaaacacattgtactgtatttgattctttggaaattggtgatccctttgtgatctctatgatgattctgtattaaccagaatattagattaaccagaacactttgttttgcctagtctatataatggaaaatgtgctgttatttgctgtcttttagcagtgtgactaacttgaagctttggtcaagggctacttactctatttgcctcgaaccatttctttcttctgctgacttcgcttgggtctggggactgttgagttaatagctgggccttgggagaaagatggtggtgtctcacagctgcttccgaggaggaaggtgtcaaatctcctgtagtgtgaaaccaggccaatttaggatgtactttcgttgttagcagagttgaaggaaagagtggagagagaaaatggcctcttggcaaggtggctgaggaaggcaggaaaggtaccaatccatcctggggtggtgggggaggagggggaagcgcttgcccagcggtgaggaacagctacaaccgggtggagggaggtgcctgggaggaagctccacccctgaactcttggcaagtcgggaggaggtggggtcaatttaagggaagtgggcgtgcctgggtgcatttgggcgtgacccaaccaggctctgtcacagatcacaggaaagggactccttcttgcttcgcttttcttgagactcttctcttgtgatgattctgcttggccggggtggctctgtccccaagattggtggtgccacaaaaggagtatatcctcccttgccctgtctgagaccccaattgccctctcctagcccctgatttcccagggacccgtggccctctcctgcccttcacaaaatacttggcactttataagagctaagcaagagttttgggtgtggattcaggtgacactgtaacgtggatgagtaagggtgtgtgtttttaatacttgatgttgtctggtatattggactctgtaaagcacatatgcgtgaaaaatcttatttgagcctcaaaacagccctgtgaggtcagtaaggggagaacagtatccccattttatagatgaggagactgcactgaaggaactttcccgaacggtacagctaataactggcagagcctgaacttgaacccagaccttcaaactcctagtccagggcattcacttcgacaccatgctttgtcctttgaagaagtacctgaccatcctctgtacatcccatccacaggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcaggtaaggctggccaggggctctgctgtcgccgcggcccgtttggcttctgggaaccctcgggcatctctacgccagccaaaggcttcgggacccagagaaacccggtgctatgatctccagctgccagagggggtcactcaactccagctccgagcctttggctttgggttgacattgaatgagttcggattggcctgcaggtgagcggaggacatgaaggcccaagccctccggtttcttatagaagtctgaacctgtgggcaaggccacggtgacatccttggcatgggacaactggataccagggagttctctggttggcttgagggagtcgagtcttttgggaggacgggttctctctcctagaatcttgggttcaagaagacagagggcatcggctgcctttcctgggatacttgcagcctctaagctaaaaagaagtacagtgggttcttcaaaccaacagaagaacttcaagtagaaacgggcacagcattgctttatccgttaaagccacagtgattattcagaggcggagtgaagctttgaggtgacccaaagtagcatcatttttgttggacctgagttgagaaggcaggcagcccaaagagaaaaccaggctttctctgaccacatcaaatgctgtgatataccattccggaggcacagactgtcacaagatgctaatatcagtatgttccactgagtactgttcaggcccattcctatagtggatttctaaatgagcaaaaagcacatctttgggttttataagaacacctctgtctctcactctcattctctgacctctaccctggaagcagcaattgattgcctcctatgatgtattcatcctgagctgccggtaaacatccgctgtctccttattagctaaaactgaataacctcatattgagtgggtagtagagtccaggtttgctataatgcaaagacggcttaacctcatttccggctctgtttaagtggaggtgtatatgatacccatctctacgctcaagagagtaattgagctaattttcatcaactatgtgacagagtgggaacaattctctttcttctgctagagcaataatagattggtcaggaatgagttgtcaagctgttggcctcagccacttgtgttaggatgaagaggagcttttgtgtatcacctaatcttctctaatggcacctggtttcctagcatggaagcttcctgtggaacatattggcgcttggaaccagaaggaccttcgaggttgcctggtccagtttgccacccaatgcaaagatagagatctccacagcattcttgacaggtagccagccagccttttcatgaacacacctccagtaacgcagagaacaccaccaatcaaggcatcctacttgatttgggggcagctccagttgttggaaagtaggtcattcttcctctgtggatgtgtctaagggttttgcattgaggcagctggatttggcacatggtctggttactttcctccagatctgatgatggcatcttcgtgcaggaatttggcaaaggccaaatgaggcaggttaccctgcttctgtctgagcctcctgacttttcttttcatcctggttttggttatctcccttcttgacctgcggagcaggtaggcagagccacttccactcacacacctgccacctccgctctctagtcctttgtgggctactataaagccttcacttctctgcaattgaataaacacccgagcctgccctgccctgggtaaacaaggtggggggctgtttctttgcctgtagcattgaacactgtaatatgacttcttcatgtttcctggggtcctcacaaggcatggttctgttccttcctcttttgcctcagcccaaatgtgtcgcatcaaaagctggagtttagaacattctgactggaagtgctattagagaccatgtagtacagcaattcctggacaggctatggggccccactagcgggctgaggctagctgggagaaagggatggcatgacagctggccttccaggaactgtgcataagctgcagccaactccttgtgctgaaatgatggcttccacatctggatctgcctttgtcaatgtcacatgtgagagcccgtgtcagggttgagagaggcgagttgagaactcttcaatctcagtcccttcatttcactaattgctaggcatggtgttcattcctttggggaggaaaacacacgggcatggctccacctcaagagcttgtgcttaaataacacaataatgatgtcttacttgttataacactttttgaaaggggttttgcatgtattatcttatttaattctcataccactcttgtgatgtagattatattctccccattttacagatatggcaactgaggctcagagcaattaggacttgagcccagccaatcacacaattgatggccaagccaagcagcactaatcttgagagatgaggttaaacacacagtcgcccctacacacggggttaggacagaccctgtgggatgaagctcttgataatggagttcccggcaggcctttttgaaattagaatgtgctttgttcagcaagctgtggctaaattagagatgttgctggtgtgttctagtgacaccagtgacttgattttcacccagaaaaggcagcaggtttctgcccttgactgccagctaggtaggctcatgatgccttctagtttcagggagttcctgtagctttgatctttgtgtcctcggagagtgacaaatggggcagtcaggtgagtagagctgaggccatgaaggcagccttctaccttttcctccctgttccccatgtacttgatacttaatgtcagcaggaccaccagatttgctttcatacgggactggagaaacagacaaagggaatgggaaaaaagcaaaaagaaattctgatttgctctgggctctgggaaaaatcctgttaaaattacccttatcttagggctagccagatgggccgccccctgctggcagggctgggagctgtctcctgcttgtagatgagggacttcgatgttgaagtatggtgtgttcattcaagaagtatttagtggaatagtcagcacagcactagatatcgatagctgatagttatacaactttgcactgcagttctaatccccaaagtcctctgattcatcttagaggaaggcgttgcttttctgtgttccatttctctgacatccgttcttttcctgtttcttgccttcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggtgtgtagctatcaaggggtattgtagaaggtgtgtgtggcggggggtcagaggaggcaggaggggggtgggggatggggaggatcaaattaacccatatttagtaaggcattctcaaactagttctcgaagggttgggggtggatttgaagaatgggaactaaagttatagttaattttaaggtctggcccatgatggcttttcctctacaatctttagattttctttgagttaaggaagagttaaagaatatggcaggatgttagcttgagtagctcgttaacatccaatcaagaagcttttgtctgggtttaacttactggaaaccaatcttggaactttctgagtcaatcaaggtagaaaacaacttgtaggaggaaggattttaaggtccagacaaaggttgattgagggtgaggctgaaggaattccactggggcccaggttctagctactcctcccctaccctgcttcccagttctttagcttctcatggaagcgtagatgctagtgagtgggcagtcaccaatcaacagccaggcaagcattcctaaaaccctcatcccaaatcaacatctcttttgggtctgatgttcatgccattggtgttaggttgcatgttgtatccttagaaaaaatcagtcttcaacctgggttaactttacatttgagagaagtgagggtccgggttcaaatgtatacctataatatgtatttgtcattgacagccaaaaacaaaagcccatcttcagcttgttttggtggtcgtgattcttatttttttttttctctctctctctctctctttttgagagtcacacgctttcgcccaggctggagtgcagtggcacgatctcggctcactgtaacctccgcctcctgggttcaagcgattctcgtgcctcagccttgtgagtaactgggattacaggcgcccaccaccacgcccggctaatttttgtatttttagtacaaaaatacaaaaaatcaccatgttggccgggctgatctcgaactcctgagctcaagtgatccgcccgccttggcctcccaaagtgctggaattacaggcggaagccatcacgcctagcgctttggtggtcatgattcttactggaatccccgaatggcactggcaagaggtgggagccccaagtgctcgtctcccctcctttccccttccccctcccagaacctctttccagctcagacaagactcaagcttatttcttcatcttgaagaatggagctgctgcttcatgccctttctgtctcacaagggtgcttgggggaacaaaggaagcaatgtctgtgacaggctttgataaccataaagtgctctccgagggttgctgtgcatcattgtgcttcgggcggaagcaagaatgagggaacagaggcatagcgtggcagggtagcagcgttcgttcccttgaccccctagagtgggaggacaggggcccagggaaagagcagggaactctggtctgtgccaagcagttcattcacgttatcgctcttaattcccgcagtggcacttgggaggtaggcacctttattatcctcattttgtagtgaggaaactgaggctcaaggaggttaagggacttgtgcgaggttattgggtggtcctgagtgatgcagttgggacgtgaaaaaggcctgtctgcctctggagccatggctcgttccatatgtctctcaggctctgaatggggggcttctgtttgtatttgggaggcactgggggaagggggcagttgggcagaaaatgctgcctccacaagcagcgctgggaaaaggtgggcgtctcaggctcctgctccccctccccttccccctgttcctcccccagacactcagatggatggccccagcccacacaaaggtaaccagcgctcgagattcagcagcacactcacatgcttctgtctggctattctgcctggcagtgggtccgctgcagtgttctcctggagaggtttttgtccctccctctgaccttcctttccccctcccaccttcctttctctcccagtcaccaccacctgctctggttgcccccatggcatggggctttgtagcaggaagcaaggggtgggggagggcggggaacgctcctgcaacactgaaagcggggcactggccaagggcttcttcccacaggggctcagagccagggggaaggagagagggggaggggtccccccacttgttcttgctcctccccctcccaggcaacttgcctcgctgctgctctctggcagctttggcccccagaaaggagagtcaccctttggttcctggcttggcttagtgaaaccctggtactttacccagcatcctccagtcctgccattgtacattctatcctcctggcgataaagcagcattgtaccctcatagctagtgccttcctgctagggcttgtacctctctgccctttcaggatggggactgatcatggcttctcgctgtcttgggattgaccagaggaaacaaatgccccgagccctcatcttctgttctctactgctcctttcctgacttgatgtctttttaggcaacttttctggccatccagggctctgcacacagctggcttgaaacaggtcaacaaatatttgttgtaataatgtggccaggcgcggtggctcacgcctataatcccagcactttgggaggctgaaacaggtggatcacatgagatcaggagtttgagaccagcctgggcaacatggtgaaaccccgtctgtactaaaagtacaaaaattagctgggcgtggtggcacctgcctttagttccagctacttgggaggctgaggcaggagaattgcttgaacctgggaggcagaggttgcagtgagccaagatcgtgtcactgcactccagcctgggtgccagagcgagactctgtctcaaaaacaaacaaacaacaacaactaataataataatgtgcccagccctgagttaagtgctgtaaggaacagaaaaatgatgacaatatgaaccctgtccccaaggagcttaaaatctagcaggagaggtgagacttacgcgtgaaactctgggtggaaagaagaaagtgaggcatcagattacgtggttcagacttggtactctggctacacagaggaagagggcccagagtgttgtggaatatggtagaagacagaggattgaactgagaccttgatgttctgaggggtttggataagtcggaaatactagttatctattggggtataacaaattactatacaacttagcagctttacacaacaataagcatatgttatctcacacagtttcttggggtcaggaattcaggggcttagctaggcctggcttggggtctctcgtgaggttgcagtcaggtgtcagccagggcagcattcctctgagggtgtgactggaggatctgcttctggggtagcttgctcgcatggctggcacattgatgctggttgttggcaggaggcctcctctccctgccccatggatctctccagtgggctgctcaagggtcctcaggacacggcagctggctttccccacgagtgatccaaaagagagcaaggcagaaaccacagtgtcttttaggccctagcctcagaagacacctactgtcatttctgcagtctcctgttggttacataggtcagccctactcactgtaggaggaaggtgcataagagcatgaagatcaggggatcactggggccatcttagaggctgactcccacagtctgccctctggcctcccccagtgattcctgtccctcccacatgcaaagtatgccacctctcccagtgccccccaaagcttcatccaattatagcatcacctccaggtcgagaatctcttctatttatttatttatttatttatttatttatttatttatttatttgtaatggagtttcactcttgttgcccaagctggagtgcagtggctctatctgggctcactgcaacctctgcctcccaggttcaagtaattctcctgcctcagcctttcgaatagctgggattacaggtacctggcaccactcccggctaattttttgtacttttagtagagatggggtttcaccatattggccaggctaatctcgaactcctgacatctggtgatccacccgcttcagccttccaaagtgctgggattacaggtgtgagccaccatgcccggcaattttttttcttttcttctctctttttttttttttttgtaacagagtctcactccatcacccaggctggagcgcagtgccgcaatcttggcatactgcaacctccccctcccgggctcaagtgattctcatgcctcagcctcctgagtagctggaactataggcgtgtaccaccacgcccagctgattttttgtatttttagtagaggctgggtttcactgtgttggccaggctggtcttgaactcctgtcctcaactgatctgcctgccttagcctcccaaactgctgggattataggcgtgagccaccgctcccggcctctcctagtgttttgtgagcacctaccctgctcacagttctggagcctttgtagttcattatctcaaagaccctgcaaggaagaaagtggggctcagagagggagggccttgccccaggtcttctagctaggggatggcagaggcaaggttcaagcccaggtctgccttagatctttctaccaccccaggggagtctgagtatgatatggggacacagtgtgatggaagatgggaacattctgtgaggactggatgtggaaggaaggtttttgctacaagtgtgaagctttagcagctgtgactagtcaaagatagccggccgggcatggtggctcatgcctgtaatcccagcactttgggaggccgaggcaggcggatcacttgagatcaggagttcgagaccagactggccaatgtggcgaaacccctctctactaaaaatgcaaaaattagctgggcatggtggcgcatacctgtaatcccagctactcaggaggctgagggaggagaatcccttgaacctgggaggcagaggttgcagtgagcagagatcacaccactgcactccagcctcagtgacaaagtgagactcggtctcaaaaaaagaaaaaaaaaagatagctgtctcatttctctttactctcagagtttgcttctgcctatttacagataggacttataaaaacctcaataaatggtgattgaggcaggtaaagaaggcatgcagagtcttgagagaagctaggatatcccctcaatctctgatttacaatccctgtggcattccttggtttatggggttgagcatttgaacctcttcatatctccccaccggctacaaactcatgggaacctgtgttgatcctggagagacttcacatggttagcgcctggcccagcgtctggcctcaaacctgacagtagtctcggccatttagggtagtgtaagcaaagtacagcatggacacagataaggtgagatggccttggccactgagggcagtgatgaccctggtggatggataagctgcctggcctgacctgacctaggactgcatctctgctttccagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggtaagggagttttcgactgaccacagggcgccgttggtctgagcatctatgaagaagcttttctccatgggctcttctggtgcttgaacccaggctggcctccctctacaccccagattgccctggggctgccttgcccctcatcacttggatgtcagcgtgtgagaatgcaaacttgcttgaatgtcaatttgggatgaatgcaattgaaatggtatcatgcagtatattcctagaccaggaacgcaatttttggatatccacgttgtcttaaatttctctgtatggtggtttcccaactcagaaaggaacaaggggtgatttattgctcactcttcatctcctcctccagcttcccctcattttcgcctctcgcagaggggccaggatcatgtttgaggggcgaggctgagctaaccccaccttatactactaccctatagattagaaagaaggcaagaaaggaagctggcatttattgagcacttcttttgtcatgtgaagagcctgattactttgtatcatttaatctcacagtaagccgatggagtagatttattatccccattttataggtgagaaaatcgaggctttgcagtgttactgatatgtctaagatcactcaactactacgcatatgagtctgaattcaaaccaaggtcttttgattcccaagtgccagggtaggtggaagactgactcattcaccataattcagttacaccttggacgtttccattgttccccactttttattgagtgtgtatctttgcctaccatatggattatttcctcagggtatgctcctagcagtggagttgctgggttagttacagagtgtgcctttggttttaaggctttccatccctatacctgagttgtttcacaccagccacactcccagccagactggtcagctctggggagctgacgtgacagtgtctcactggcaagcagcccatctttcatgagcacctagtgtgcgtgcctggatagctgccgagggagacctaaaacaaaaatcaagaccaatccctgccgtcaaggttaatttaattgtcttgtaccctgggcaaaaccagccaacaggaaaccattggaggggccaatgggacagggctggagcactaaggcagcctgtcagggagggtggaaggagcccttttgggcctgggggaagaggcagacatctgcactggtgaggagggtgggaagcctcgggctttctcccgggtaaaggagcttgacagtttctatatacagccagcagcacccctgacacaggctgcacacacagccgctctagccagctagcctgtgagctgtcagacagaaaggtggagtggcccatctccccagtgccccagagaggactggcaatggtgcagctatgggatccattgtttggaaagccaggcagccattaatgctgccagcctctcccctcctcacctcattcacccagcttcagcccatgctagctagggtgcttcaagtccctggtgtcccacctgtagtcctagcatcatctcaatccaaggaaggcagtcattaaagtgtggatgaatggcagtattggattatcctttttttttttttttggagatggagtcttgctctgtcacctaggctggagtgcaacggtgcaatctcggctcactgcagcctccacctcctgggttcaagggattctcctgcctcagcctcctgagtggctgggattacaggcacctgccatcacactgggctaatttttgtatttttagtagagagggggttttgccatgttggctaggctggtctcaaactcctgacctcaggtgatctgcccgcctcagcctcccaaagtgctgggattacaggcgtgagccactgcacccagcctattggattatcctgatttgaggggagggctagaactgactgtcctggcttgaacattggtcctgccgagacgtgcatccagggatagtccttaaaacaattgtcttccttattcttgaattgccaccagaggctgtgctctccaccacatctcatttctctggtctggggctggcttgccaagctcagggagtcgaggtctgagtgcttgagctctgggcgggcaggtcagcctctctgaggacctcacctcaaataccaccacccagatgagtgtccttggccataaaaaaagtctctccaggccaggtgcggtggctcacgcctgtaaccctaacactttgggaagccaaggtgggcagatcacctgagttcaggagctggagaccagcctggccaacatagtgaaatctcatctctattaaaaatacgaaaattagccaggcgtggtggcgtgcgcctgtagctccagctacttgggaggctaaggcaggagaatcgcttgaacctgggaggcagaggctgcagtgagctgagattgcgccactgcactccagcctgggcaacagagtgagactgtctcaaaaaaaaaagtctctccactgccaaggaaacggcccagagctggggtcctggcaattgtggctcaggactgatgttgttaatgaaagattttgaagtgtgtccctgctataaagggcaggctctgagactcctcagatatttggggagctttgagtctcagggttatataagttcaagaattagacctctctttgctcatggagttgtccctgtccccacaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggcaagagggctgcatctccccccagtcccgccctcactcccagctcagcctctcactcaaaagaccttgcctgccgctggcaggcatggtggctcacgcctgtaatcccagcactttgggaggccaaggcgggcggatcatgaggtcaggagttcgagaccagcctggccaacatagtgaaaccccatctttactaaaaatacaaaaattagccgggtgtggtggcatgtgcctgtagtcccagctactaaggaggctgaggcaggagaattgcttgaacccaggaggtggaggttgcagtgagccgcgaccatgccattgcactccagcctgggtgatggagactccgtctcaaaaaaacataaaaaataaaaaaataaagaccttacctcaacctgaaccttcgtagcacaccagactgcgagttgcagagaggccttgacaggaggagttttggaaagacttctataggctcaagagggaaccagtttagggcaggagccaatgagttagttcccagatggccaggccgcatcagttactaaggggaggctgtggttgtctagggatcatcccatcatgtgtagctgtcaccaggaagaccactcggtcttccctcaactcatcctggtgggggacgtgtctcagacagaatagaaactgagaggttgacctgagggtaatatccagatttgatttttaaaatttgatctctagacactgtaagaaaaatacacctgctgtgtcttagagaaattgtacccattctcctctgttctaccagagagcctacttcctgggcaaattagagacaggagctgcagatccaggagggggctccgcttgggttctgcctggcgtgtggagcccttctgctcatctctgctctcagggagtcacccagggccttcagttccctgaactgaagtatccctctacagttgcccccaccttttttttttttttgagatggagtctcactctgtcgcccaggctggtatgcagtggcacaatcttggctcgctgcaacctctgcctcccggtttcaagcaattctcctgcctcagccttctgagtagctgggactatgggtgcccgccatgacgcccagctaatttttggatttttagtagagatggggcttcaccatgttggccaggctggtctcaaactcttggcctcaagtgatccacctgcttcggcctcccaaagtgctgggattacaggcgtgagccaccgcgcccggcttccctgcagctgccttaactttattgtaggtcagggacccatcctctagtgaactccacaactaccaatagagctacattgtgccatgggaactgtcccaagatgtcaggggaacgtaagagagagagagtaatgggagggaggaaaagggggtacagagagaggaggagttggggagatggtagtggagagttgcaaggctacaggtggttcccttgtcctaagtcttaaaccatattacaccaaggttacctgggggtcagctcagttttttcccctgatgcagtagccttaagtgtagacaccccagttcccacttgggccctgttatcctcaccctgtatcacctccacaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtggtaagcatggtccagacttgacactgttgtccttggggccagcctctgattcctgaacttgtgaggacatcctcttcatctccttccaccttgaacagctcccatgagggccatctgccctcttcacctgctttcattcaaagagctcaagaatctcagtttgcttgaaaaagtccaaaggccacttcctcttatccccttactgcaagtgtgtgcgtcctcttcagggccctgggagcccacagggacctatttcgtagctagggatctagggtgggcctctgtgtgggggcggcagccccactagtagacctagctgggggcagaatgtgttgacctgtgctttgaatgggatgtcagttgcaacaaagtgatacttagcattttgcttatgtgtttgcaatttcttcttgtttgtgatcaagtggatcacagtggaacccctgggatgcttcccgaagcttcattctttacagcccttgcctgtgggaactgtgatgttccctctgcatcccagggtcccccttccttccgttccttttcctccctcacctgccccttctgtaaagtgtctggtgttgaggcccatggcaagggccacaagccaacatgcatttattttctcattagtggatagcagctgtttgtctgcagttagatagctctactgagttgggcagggggaggagggaaggaggggagtctagcttgggcatgctcagtaggaatctcctcagacttgacctctgaataaaggaaccctgcctcttagtgacatcacagtttggcccttgctctagcagtgacttcttcagactgcctgagcggcggagcagctgggagttgtatctctgaaccttcttggaggctgcagtgtttgtattgtggttagaacccctctctggccaggagccaacaggactaaggattggcccaaagctgctccctcttctcacccagactttggccctagttagccccgaacctctatacctccagatatatggttccaggctcccaaccaggggctcatttgtttatccaacaaaggttaactaagtagctgatgatggaggaagaaacaaaggggacctaactaaaggctcttatggaaggggaggactaggtaggcggtgagtggggggtaataggaggctgtcgcgggagatcttgactcctgctcagccagcctccacccaggtctcagctgagctgactaaaccttggagcacaggccttaggcctgtacagcctgactagcatctcccaggctgggggcaggatggctgccttttctgttttccctccctccagctctgggttcccaagcccctgtccttgaggcgcagagcagccttggaatgttcattcagtcatttgtcctgggccagtggtgactgttgttccccttagctgaaccatccctaggggtgcagggcttggggcaagccaccgttggtagctgcctcccacgtactgtgtacacatgcactctctcttagacacatacacgtgttatctgcactccactggattcccaggaaaatctgagaccaacaagcatccagagcatcttgatatgacaaaggcaccacacgcagctctgtctttgagaaaccggtctagtcccgaggcctccttaggctagaaactgccatcccgagggtctcaggggctcctagatctaaataacactgtgaccaccttagtaaacagatgaactctttgcttccccaatcccttctccaaaacccctaaggagtaggaatgtggaaaccattttaagtagttaaaaaatgggaaataggccaggcgcagtggcttatgcctgtgatcccagcactttgggaggctcaggtaggagaattgcttccggccaggagtttgagaccagcctgggcaacatacggagaccttgtctctacaaaaaaatttaaaaattagccaggtatggtgactgcactccagcctgggcaacagagtgagacagtgtctcaaaaaaaaaaaaaaaaaaaaaagagacagagaggagagaaataaacacgtttctcttatctttctgtctcctcatcccaactactagctatcttttggttttgttttgtttttggcgcgatcttggctcactgcaacctctgcctcccgggttcaagcgattctcattcctcagcctcctgagtagctgggattacaggcattcgccactatgcccggctaatttttgaatttttagtagagacagggttttgccatgttggccaggctggtctcgaacttctgctagccagctttttgacacctcctgaaactaaattgaatgccagtctatgttgcagaattcagagaagacttttattttttttaggcggagtcttgctctgtcgccaaggctcgagtgcagtggcgtgatctcagctcactgcaacctccacctctcgggttcacaccattctcctgcctcagcctcccaaggagctgggactacaggcacccgccaccaagctcggctaatttttgtgtatttttaatagagacggggtttcaccatgttagccaggatggtctcgatctcctgacctcgtgatccgcccgcctcggcctcccaaagtgctggaattacaggcgtgagccaccgcgcccggccccagagaagacttttcttaactctagtacttcacatatttgtggtgtgtgtgtgtatgtacgtatatgtgtttatatatatttgagacagagtcttgctgtgttgcccaggctagagactccagcacttcctaacttgtcctggctgagcacctttatttagatttgttaaaaattactagagacagtgtcttgctctgtcaccgaggctggagtgcagtggtacaatcatagctcagtgcagtttcaaactcctgggctcaagcaatcctcctgcctcagcctcccaagtagctaggaccacgggtgtgtgccaccggtcccagctaattttgtattttatctttttgttgagatacggggtttgctatgttgcccaggctggtctggaactcctgggctcaagctatcttcccgccttggcctcccaaagtgctggaattacaagtgtgagccaccatgcccagtcttcatttagaccttttgctcaatttatgggcatgaatcaggcttaataatgggagtcaggagccaatgggttgctataaagtgcaccagctcttttccatgcaaaggcagcctgggaccttggcctaccaccacaggaaggcaggcactggcaggagtcagcaggctctcaagaagcagggggcccttaggcccaaaggctgtttgtagggtgtgtgagaggacagcactcagggacttttttaaaaattgaggtaaaatttacctaacataatcattttaaagtgaacaattcgggccaggcgtggtggctcacccctgtaatcccagcactttgggaggccaaggtgggtggatcacttgaggtcaggaactggagaccagcctgaccaacatggtgaaaccccctctctactaaaaatacaaaagttagctggaccgtggtggtgcatgcctgtaatcccagctactcgggaggctgaggcaggagaattgcttgaacccaggaggtggagtttgcagtgagctgagatcacaccactgcactccagcctgggcgacagagcgagactccgtctcaaaaaattaattaattaaaaaaaataaagtgaacaattcagtgggatttagtacattctctttttttttttttttttcctgagacaaatctcactgttacccaggctggaatgcagttgcatgatctcagctcactgcaacctctgcctcccaggttcaagtgattctcctgcctcagcttcccgagtagctatgactataggtgtgcaccactgtgcctggctaattttatatttttaatagaggtaggtttcaccatgttggccaggctggtctccaactcctgacctcaagtgatccgcctcccttggcctcccaaagtgctgggattacaggcatgagctaccgctcctggcccatttagtacattcctaatgttgtgcagccaacctcaggggctgtttggatgccttgaactgagtgtttggctctcatttttcatgcctgtgtgcctccctgccaaatctccaggaaccactgggtaggttggtagggtggctgcaggaagcacccgagtgtggagactggaggctggggaagcttttccctccactgctctgcctcctcagcccctacacctagatacatttacatggacttctgatttatttatttatttttgagacggagtctcgctctgtcgccaggctggagtgcaatggcgcaatcttggctcaccgcaacctccgcctcccaggttcaagtgattcttttgtctcagcctccccactagctgggactacaggcgcccgccaccatgcccagctaatttgttatatatatatatatatatatatatatatatatatatatttttttttttttttttttttgagacggaggctggaatgcagtggcaggatctcggctcactgcaagctctgcctccctggttcacgccattctcctgcctcagcctccggagtagctgggactacagtcgcccgccaccatgcccggctaattttttttgtatttttagtagagacagggtttcaccgtgttagccaggatggtctcgatctcctggcctcgtgatccgctcgcctcggcctcccaaagtgctgggattacaggcgtgagccaccacgcctggacatttgttgtatttttagtagagacggggttcaccatgttggccaggatggtcttgatctcttgactctcgtgatctacccgcctcagcctcccaaagtgctgggattacaggtgtgagccaccgcgcccagcctgattttaatttttttactttgctgtctggctgaggtatttaaaatgcttttggctttttgtccccaagcatttgcttgactagaccctctgttgattaattgtcttcatcttcccctagtggagtccagctgggcagaaaatgaaggagaatccctttagggtgcacagggctccatttttggcgggaggaaaaggtgagcattagcgtcagggttatgcctcatgtagcgcttccctggctgtgtgcaaaggcccctgttgtggaaagttgtcgggggaatcaaatccttttctcttttttctttaattttttttttttttaagatggagtctcgatcttgtcgcccaggctggagtgcaatggcacgatcttggctcactgcaacttctgcctcctgggttcaagcgattctcctgcctcagcctcccaagtagctgggattacaaacgcccaccaccatgcatggctaattttgttttttcagtagagatggggtttcacagtgttggtcaggctggtctctaactcctgacctcaggtgatccgcctgcctcggcctcccaaagtgctgggattacaggcgtgagccaccgcgcccagcagtaaatccttttctaagtacaaagaaatgtcactgttttccggtatcctgaagtgagtccttttgtaaagcagaagatagataattcatctgggttgtaaatgtagattttcttatattgggttgacttaaggtgaggcccatttctcctgagatcatgaaggatggagtggcactcctttattcattcgttcatccgtccatttagtgagcacctattagatttcaggtgctgtcctgggtacaggaggccagacggtgaaccctttctacctcatgcttgggcttggagcgccaagccatccaaactccctgagaggcctctggaaggcctcccccttcagccaaattacaggcaggtatgtgactgatttacctttgtccctttgaagaagagagcaatatccaagctggctgaaggaaaacagacttgtttttcctcgtctgttggaaagaatgtagggcttacccagagttgatgcagtttggttcgggacatcagaggaagtatcaggacactctgccttccacctatgaaagggttagtagtttaccgcttgaagtcactgaatcacaggttattgtttttcctgctagatacctctgccatatgaccccatgttgaagaccactagttttttgtttttctcatctttcaagtccctcagctggtgagtgagttagaggagatggggaggggtatgatcggaccctgaggagtagacaaactgctggggtagcctcttgaattgaggtgagaggctctattcttaccatgaggcctgagggtgctttttatttttatttatttatttacttatttatttatagacaaggtctcactttgttacctaggctgaagtgcagtggcgcagtctgggctcactgaagcctcgacctcccgggttcaagcaatcctcctgcctcagcctcccgagtagctgggattacaggcacacattaccacaccaaaataattattgcattttttgtagagactgggttttaccatgttacccaggctggtcttgaactcctgagctcaggtgatctgcctgccctggcctcccaaagcactaggattacaagtgtgagccattgcactgagcttctgcgggtgcttttttaaaaaagaatttatcgagatgaaattcatgcaacatgaaattaacaatttaaaaggaaataattaggctggtcacattggctcacacctataatcccagcactttgggaggctgaggcaggtggatcacttgagcccaggagttcaagaccatcatgggcaacagagtgattcctcatctttacaacaataacagtaacaaaaattagctgggtatgttggcacatacctttggtccccattacttaggaggctgaggcaagaggatcacttgagcccaggaggttgaggttcagtgggtcgtgttcatgccactgcactccagcctgggtgacagagcaagaccctgtctcaaaaaaataaaaacaaagcaaacaattcagtgacatttagtatattcactatcttgtgcaaccacctctatctagttccaaaacattttctttttttttttctttttgagacagagtctcactctgtgacccaggctggagtggtgcagtggcgtgatcttggctcactgacgcctccgcctccgcctcccaggtttaagtgattatcgtgcctcagcctcctgagtagctgggattacagacatgcaccaccatgctcagctaatttttttttttttgagacggagtctcgctctgtcacccaggctggactgcagtggcgcgatctgggctcactgcagcctccacctcctgggttcacaccattctcctgcctcagcttcccaagtagctgggactacaggtgcccaccaccacacccggctaattttttgtatttttagtagagatgaggtttcaccgtgttagccaggatggtcttgatctcctgacctcgtgatccgcccgcctcggcctcccaaagtgctgggattacaggtgtgagccaccgcgcccagcctcccaaacattttcatcaccccaaaataaaaccccacacccattaaacagctactccccattcccccttcctccctgccccccgcccaaccactaatctttctgtctctatggatttccctattctagacacttcatatcaatggaatcatacagcatggggccttttgtgtctggcttctttcatgtagaatactgttttcaaggtctagccgtgtgttagcaggtttcaattcttcattcctttttatggctgactaatattctcttatgtggatatatacgccattgatggacatttgggctgtgttccccttttggctgttctgaatggggctgctgtgagcacgcatgtacaaatacttgtttgagtatccattttcgttctttggggcatatacctaggagtggaattgctggacttagggtactttttcaaggaaaggataagagaaaagggctggaagcgtggctggggtggagggaatcaagggaaaggaaggtccctcttcatctggactgtatgtgaacgtccgtgaggaaatggtaatggaagccacaccaccgaccaaatcttggagctcctcctgtgtgccactcatgggcctgtttgagctttagcttctttgctcacgccagttaacttttggctgtctcaaaaaggcaaattcacctgcaaatgacaaagattggtagtcagtgaagagaattagaggaatgtgccagaggctttgaaggaagttcccagagaggagccccaggaatgtggtgagttagggctgctccgatggaatccttgtgtgtcctcttgtggggaagggggacagcagtcatttgaatgcatgtgtttcggcatgttggttaagcaagcactttctagtctcgccttgtaggaattcctccctcctttcctctccatatatttattaagctcttactatgtgccaggcactgggtttaggtacggcagagacaatggtgaacaggacaggcatggtccctgtctttttagaacttatgctctcactccataatctcccatgacacctaacacagggctaggcacagaagacacacccacctaactgacaaatgtttctggaagaaactacttccaaccctcaagtgacatggggtacaaaggagcacctgagccgacagcgggactgcagttgtttttcagggagtgcacagaagatctaatgtgcatgactagaggtttcccactctggttgctcagccatgactctgaaagcttctctctggctgccttttcctactgggggaaacccgccatcacctggaaggttgctaaagaaatgagtcatttcagtagctcacaatgctaataggtgttcttgtcgataggatgatcccaaagggatattgggtcatggtggtgcttcgcactgggggaaactagctctgctcctttaagttggctgccaacttcctcctgggatttgctttctggggggcaccctcacctcacctgtgccctttggactgtctcctgtccggttgcctagctgtcacctgagggctggtggcaatcatacacaactaagtcagcttgccagttgtacagggtggcatattggttgagccatgtgtacccttagatggtacagttggatttgtcgtgaaagccaatggacctactttttgttcaggtaggaataagaggtgaaacaattccactaggtagtgcctagctaatgaggaggctaagcggtggccttagcctcctcatttgtcttgtcttgtctgtagagcaagtaaacaaaagattgttaaaacttttattgtggtcaaatacatagaacccaaagtttactattttaaccattttaaagtgtacaattaagtgacagtaagtacattcacaatgttgtgcaactaccaccactatctagttttgaaactttgtcataattttaaaggaaaatcctgtccccattaagcataccctcccgctctcccccaggccctggcaaccaccaatctgctttctgtctctatgggcttgcctcttctggacatttcatcttaatggaatcatacaatatgggacctttggtgtctggcttctgtcacgtagcatccatatgggtagcatgtgtcagaatctcctcttaaaggctgaataatattccactgtatggatataccacatttttgtctgtttatccattcatccattgatggatgtttgggctatgtccaccttttggctgccatgaatagaactgctatgaacgtgcacacagagaggtacttgtctgacaacctgtttttagttcttttgggtatatagcaggagtggaattgctaggtcatatggtaatgctgtgttttaccttttgaggaacgaccaaacttttccacagcagctgaaccattgagtatttccatcacaaatttcatcagttggtgggcatttggattgtttccaccttttggcttttgtgagtggagttgctgtgaacattcatgtataagtttgtttgtttgtttgtttgtttgttttgagacagagtcttgctctgtcacccaggctggagtacaatggcattatcttggctcactgcaacctctgcctcccaggttcaagggattctcctgtctcagcctcctgagtagctgggactacaggcgtgtgccaccatgcctggctaatttttatatttttagtagagactggatttcgccattttggccatggctggtttcaacctcctgacctcaggtgatccacctgcctcggcctcccaaggtgttgggattacaggcgtgcgccactgtgcccggcctcatgtgtaagtttttgtttgaacacctgttttcagttctttgggatatatacctaggaatggaagcaaaaggattttatgaagataaacctggccatttccccatgttcttcaaaaatgaaccagaaggacttatgcttatttatattactatacattggagagattatgattcgataaatgaacattgtgaccagcagggaattaaaatcctgggataggtctaagattctgcttgcagggttaaagctctacaccgtataaagtggaggtcccaaacctaaatgccttcaggcttaaaagggagaagcaggctgggtggggagtggcgaattggagcccagcccgcgtgtgtccctgttccctccagccagctgttgacatgcaggaatttggacacaatgttgccagatcagattttttttttcacagaaatattgggaaatctggatttttaagtgaaattgcccaatttaaaaatgtcggaagtggggccaggcagggtggcttatgcctgtaatcccagcactttgggaggccgaggtgggaggatcgcttgagctcaggggtttgtgatcagcctgggcaacatggtgaaaccccatcctttacaaaaatgaaaaaaaaagtattagccaggtgtggtggtatgcacctgcaatctcagttactcgggaggctgaggtgggaggatcacttgagcccaggagttcaaggtgccgtgagctatgatcatgccactgcactctgggtggcagagcaagaccctgactcttaaaaaaaaaaattaaaatgttggaagcaaattgggattttttttttcttttaaagcactgggtcaaacactaggcagtcagtgggttagattggtctcctgtccccttgttggcagtctctgactgagaacaggaagtgtgtgtctctctggtcactcctggactctcttgtggtccttccttcccttctcccattcccttagccccgtatgcatggacttcacttggacattccttccccagcctaacctccttgtctcactgcctgctcttctttcatcagatcacctctcggatcttcagggccgggcagagggtgatcccggtgtatcctgggatttttacagcagttctgtgttgggtaagttttaagtgagattcttcccacccttcttctcaaggacaggagtagccctgtggtggtatcccttcttcaccttttagtggcttacagaccctttcagaccaaacctgaacctgaacccatccttccctgcagactcagaagtcatttgtcgaaactgggaaatgcagcactggtttggacacagccatccctcactagccctctaccactccccaccctgggcatttaaaaaattctctttcttccgaggtccctttcttctccctggctttgtcttaaccctgccagaagcctctatgagcactgtcacctattccagtattgctcacactcaagagggaccccacccctcacctgagacctaccattccctccctaccctgcccccacgatgcacacgcagtttttggaatagctactgtcttcggagcccttagccttctggccgcagctttcctctcctggaagaccagcaggcctttatccatggtggtcatctagcattcgccctttgggctagggactgaagatgaaaggaaacacccactcctacccttgggggaagctggaggggagaaagtcaggatggaatgcaactggccacacccagaatgtgggctggggaaaggaacccgctcagccccctctgggcttcgtgggagccctgcaggcagtgaggtggcttgggaaagctgcagctagagaaggacaggtgtttttaccttgcccttgtctgctgatagtatcttcaggcttccatctcccaacagctgagcagctcatccttgacgtcaccttgcttttgccagttggaggggggagtgatataataaatctctggccacacaatgatttctttcagtactagaactttcatgtgccctctgaaggatgtgagccatggaaccggcaaaccgcatccctgactaggggcctgtggccttgtcatttacctcccaaccaccacccctccatgcccctttatctgcttagcgcatttcttttcttcggttttgtacatgtatctgagtcctaatcccctatatgctccccttacagaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggtaagtgtccgagagatccacggtgactgagtgtcaggatcctggcactcagtaggaaggtggagttctccacgaggaagtgaagacctggcaacgagtgccatcacacatgacaaaggctagcctgcccttttagcccagagtagtcatgttcaaactagaggctgcagg

SEQ ID NO: 976 - DNA, 71915 bp, mus musculus; identical to SEQ ID NO: 975

SEQ ID NO: 977 - DNA, 33816 bp, mus musculus
cttgacccactcctcaagccctgataccggggcgaggccccttccttttctagtccttctacgcgccaggtgggtgggtttcgcggtgacgaggcgacacctctttcccctctggcgagcacgttaactggggaagctaccaaattctcacgccttagctgccctgcctccacctcccgcaagtccggttgcccctctaggcttctgcgcctgcagtggttccgaccctcgcctttagaactctgccgcttccgcctcttatttcgcgcctttgtttttagttttggaaggggcggagttgaaatggctgcgccgcggttgccgaagcaacgctttggttacttccgttggtttcaatgcttccgggttggcgctgcagtggcgtttccgactgtgggagcctcagcttcccagtcgtccgatgagcccgagcaggtgagggggagctcctggacttccaggctggggagcggggctgggccgcgccaggccgcgcggggccgggctggcctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaattagtttctcagacaggataacagcagggacatttatggtttcctgtcagtgattccttgttgttgttgtttttccccccagcctagagatgcctagcgttatcatgaactcttccctcgtcttcattccctacatcatcgagttctttgtgtcttcattggggaagtctatctctaacctcagtgccaacaagcatctttgtctgctgtactttgcaccatcctaagctagtctccctgcctctcccgtttgtaatgtaatccactgtgtttgctgcagccctaataggctaaaatgtggtggatttcctcaagtcacttcgttgttaaacacacacacacaaaacatgcagccccctcctacaccccctacccccaccccttggtttcaagcctttcaacataacatgctccttatcacacttcttgtctgatactgtttcagtcaacaagggaattctctgttccagttaggttcctttcttcttggcacaaaccatactgatgcctgcttctacatgctgtgcttgttcccacatttgtgtttctgttcattctctcttccctgcccctctcccttacctgcacctaaccaggttgtacctaccgtctctcaaggttcaatttaggttctctcacctcggcaattttcaaattagtcaatcccatgctggttgtagtcttttctatgctcctcttgctcttaaagtttgtactacacagtttagtacttaatttttctctaacgcactactttgatttcttccaccagattataagctcttgaaaggcaagtactgtatttcgtacttttttctctgtcccatctcattggttattcagaaaagacaggttgagtggtaaatattgtcttggtgctagaacgaatatctgtgtttttcaaatatgattatacccaaagtgcattgcaggtttgggcatttagcatgccttcaataaatatctgcttggctctccattgttaccttctgaatctgagaatctctaatttctactctttcttaaaggagaaagcaggagaggcacccagagtttcctgaccagatcttgggagtagtatagggcaatgtaacttgtattgtaggacattcttactttcactcattagtctatcaaattctccgaagtcagatcttcagaataaatgttggcattttgaagacaattttcattggtttctttatacagtaaaaatatttagggtactatatttttattttaccttagatatgactacttttacgcatatttggggttagcccctacaagttaaaataatttttagagggcttggggtattttacataagtaattccttggaacaaaagcaagggaacagggttcgcaggcagagaatatctggggatcaagatagtgtcatacacagggtgtgtagcattggccaggtccagcaagttaccttccttgtttcctctgcaatcttttatatacaggctgcatacataggtaaaggatgtcacactgcaaaaccaactaagtattgaatggatatgtattcaattctatgcaagctataatgggggttataaaaagtactgtgagatatagtatcttcccttggggatcttacttagttaagagaggaaataacattggacatcttgaagttgaccctcatcctagtcattatttttatgcctgagattaagatatagaagggataaaagaaggttcaaaaaatattgcacacctgtagaataggtgtgacacaacacgcatgcatgtagacaactttatgtaaaagacttggaggtttcagctgacagtttaatgatttgatagtgtgatgtggctcccaaaaaagtgagtgcaattttaagctctagtaattgaagtataatgtgtcaaatgaagagaaagatcatggatatttagctcaagaaacatgagatgtaagagaacatcatagctgtctttaaatatttgaagggcttgcctagggaaaaaagaatgcatttgttgaatattacctccaaagactgggtacaaattagaggaagacagacttttggctcaatatgaggagggagtgtctaaaaacagatctaatcaaatatgatccaggatttcttcataagattttttcctaacattggagtgaaagagattttactatcagatgggggtagggaagtcgtgattgtggcaatggtgggttttgcctgtggtctccagatttttggatttcatgggccagtaaaatgtaaatgaaaatgtgggaagggtacacaaatacaggctagttagcctgtgctccaggcgtaagaagaatctgatctgttaataatagacagtccctaaattaaatacatttagctgaaaaaaaaaaaaaggactaagtgtccttatttttttcatttcgccccagaattgtgggaacttcattagggaaccactgggctaactggcctaagattcagcgactggtctttcatcttcctgccatgtcctccctgttccttgcctttcactgattcatcattgctccctgagcacattttccttattaaagggctggtagcagcttgtgaagttccgatagaggctttctctgtaatacaaagagttgaaaaaagttgtaaggagaaaaagttttggagagacaactttaagtaaaagtagctgtctgaaacctttaagactatttggggcaatcgataaatttgtgaatggagagttaattttttcctcacaaactcaaagaggggatatgccatggtcttgcttttccatctctactctcaccatatgtgtcatattttactatcaattctaattggaaaatgtgggcatagctagaaatggtgataaggtagtatttagtcttcaagactcctatttccagctgcagttgatacttgaagtggctattcctactttgctcattagaattcttttcaacaactttccctcaaaagggctatctatcccagactctatatgtgctatgcttgaaaggaagcctccataatgatttttgtggcctgtaactaaaacatttaatcagcgtgtttgctatcttctctggaaaattgtattttgcttagttacagagaattccttatgtggaaacaaagcaaaaccttcaaagggatactgtgactcatagctgctaaccccagactgggcaatgggagggaggggtgggcagcaagtaatatctgttaagatgtaaatttgggtacttaaatttttaaaaatgtaataatgatagttaactaacaattattgagctacatgccaggcacttttaaaggtgtttttcatatattatttaattttcacaacaaccctatgatatagtttttattattagttccattttacagttcagaaagtggaggcatagagagattaacttgcccaaggtcacagaactagtaagtggtggagtcaggaaatgaatctggagttagcatttaaattttaacagtctgacttcaggagtctgcattcctcaccataaaccacttggaagttgcttttgaaattcagaagtatacatactgtgaagctctgaaaaaggaatatttgaaagaaatctgagagtccatgctaagaacagatactactttcagatggaccaggatttagtaggcaatgcctagagcagttcttaagtgtggaagtatcagcgttatttgggatcttgcaaattctcagggccataccaccaatcagaaactctgggggagaggcccaacaatctatgttttaatagaccttctagatgattctaatacatgctaaaatttgcaaaacctagaggccagagctctggaaaaaataaaatccaagagagagcaagctgacagtggcagaaaaagagagtaaagctgaaaagattgatgatgacaggtctaacgggggtgggatagggaaggagaaaagggaggctgggagcagaatacgttgttaaagaactagaacataaaagaagaacagtatttatatgtgtgtgttttaaaaggccaagaggaaggaaaaggagatccactagatggatgtacgttaaatgtcagagggaagatagacatcatattgctatcattcctttgggcgctagaaggaaggtgaaaaagttcttagctcagcctgggcctagttggggggacaaagttatatatagctagataccctatagtagagagataggagggctaagaatatgagagagtagtagtgtgagcctgtgctttgcacctgaatcaagctaactgaataccatgaactgcttttatgagatgcctcagcctatataatttgaattccgggttccttcatttgtaattatctagttgaatgtcaaagttgggtgtgctggatggactgaagcctcttctctgggtggggatgaatataacattaaagaaactggagagaatgaagggcacaggttgatctctgagtgaatcacacgcctacccctacaaaatgtcagtaaagaacaaactcatgatcatccagcacataaaacaggatcccccatttttgtgtcattccacttggtggggtttttcttctacatctattttatttgccaattttgtttatctaaattatatgatcagatgctaacaaatgctcctcactcttgtgccttgttctgatttgtgtttatttttagcaccagaaaagtaccactgtaagtcatgagatgtctggtctgaattggaaaccctttgtatatggcggccttgcctctatcgtggctgagtttggtaagaatgtgagaaatgacaaatctgcattatacggtatagatggtagcttatgatgatggttatttttggtgaaagctaggtaaaaaataagaagctcgccttattttgaaaattgtctcaaagccatgaagtaatatttcagggaaagtactactgatggtatggcagatgagttaagaaaagtcaaactaaggaaagcttttttggtagtttagtgatttgttagtttgctaggcttaagtaaaatacatgaatatatagagggagttgatatgtcataagggtttttgctatatttctgtattaatagtcttttatgctaaattatttataagtttatttgtactgaaagtcctttttttcaaacctctttcccattttagaagaaaatgtactaacaagatcaaacaagattctcttctacatgattttgattttgaaatatttttagattgtcgtttttttcatcttccagatgttctcttttctaaactattcatgagtgactactgacgttcttggcatatcctgtggtgttgtgatatttgggtcatcagtgaccagagctacctaatcaccttgttagttttacaccctgaaatatattttgtcaatgtgatgaccacttctgtttgttgatgtaagaggtttggttaaagaaatttcccccccaaacactctgctggtattagtcctgaattacctaagggaccaggatgagtagaaccaaataagactttgccattatctttcataatattaggggactatttgtttcttgtaaacagataaaagaaaaaccccacaaaactttgtaacactatataagagcatctggagcagcaatcccatgctttcctatctttgtgaaaatttagggagattttatgagacacagaggtggggagacttggggtgggaaggggcaggagggagactgataaatgccagattatatgttacagatgaaataaaaaacaacatttaattattttgcatttataatagggcaatctgaaagcattttattatattacagtttgaagtatattgtgggtcaattggtgctgcctatgtatagtataatgcatttcacttaccacatgcaactcatgttctctgacagtggtattctactagagctcttctatgtgttataaaaaggactttgtcttaggattcaaatattgtccttggcttatatttagcaacaacttaactgtgattctttggacatacttataaataagtgtgttcctttatagggactttccctgtggaccttaccaaaacacgacttcaggttcaaggccaaagcattgatgcccgtttcaaagagataaaatatagagggatgttccatgcgctgtttcgcatctgtaaagaggaaggtgtattggctctctattcagggtgagactggttctttccttatatcattaacagaaatgctttttaaagaagccatagttttcagctgtctgatagtttgtgtccgtttcatattcaccatttcaacttgtaattcagtattgatatgccagtttatatttctcctgcttgtaagtcttgagctttggattttgtgttcatttggttataagtgataataacattttaaaatggatatgtcattgcagcataggctttctgtggatttcccgagagtcactaatagccactgttaataacagcaccaattaattatatatatttttgtgatatccctcctgagttggcaaattctgacttcctttaaaattttcctctttgaaaaaatattattcttgcagtttaaacagaaagtgcataatgagagagagggagacccatctttatcatcaccttttgattagccataattttgtggtttactgtctagtttgtagtttatctgttgccagtttcctaggccactcctgcatctaggctaccagtttattactcagagaatagacatcaattttattgttaaactatgttacatcgttaaactatgttagacttaatttaaaaggtaattttcttgggggaaaaatcaagtagtgtatcctgaagcatcctgaagatgatccaccatcctgatttgtggatcatctgtttcaccttgttctttcatcagcatagatcatcacaagatattttctgatagcaagcaataaagtcagaaatatgcatatttagtcatcatttaaaaatcctaaccatttgagctgctgctgtctttctatttatacctcctacagtatagttctgcaatttggaagaatcccaaaggaggtatgaatgagaatgtctccagtttaaaggagaacttaaatagggtggaattttggctctagtacctccttgttgatgtgattaaagacgtatctgcaactgttaggaagtagaggttgatttttttaaaaaaatctttattaggtgagcaatgatgtataattctttttatacattgctggattcaatttaccaatattttcttaaggagttttgcatctaagttcatgagagacattagtctgtggttttccttttttgtactgtttttgtctggttttggtatcagggtaatactagccaaaattagttgggaagcattccctcttctgttttctggaaggaactgtgtaagcttagtgttaatttttaaaatgttttgtagaattccccagtgaaattatctggggctatttctttttggggaacatttaaattcagagtgcaaattctttaaggttatcatagtttggggtgctataacaaaataccatagactgggtgacttataaacaatcggaatttatttctcacagttctggaggcaggaaatctgagatcggtgccagtttggtcaggttctgctgaggtctcttttctgggttgcagactgccaagacttcttattgtatcctcacatggcagacagagtgagggagctctctgggatcccttttataagggcactaatcctgttcatgagggctttaccctcatgacctaatcacctcctattaccatcatattgcgggttaggattttaagatcttgatttggggacgatacaaacattcagtccattgcaatgggtatgagttttattcagattatttgttttatctagttgagttttggtagcttctggttttcaaggaatttgtccatttcttctaaggtgttgaatttatgagtataaagttgtttataccatactcttattgtccttttaatggctgcaggaattgtagtgctagtccctgtttcatttcttatttgcatcttctgtctttttatctttgtgagtcttgctagaggtttatcaattttgttgatttttttttaaagagctaactttttgtttcattgatttttctctattttcctattttcaatttcattgatttgtgctttttattattttcttttgcttgctttgggttattttgcttttctttttctagtttcttgaggtaggagcatagattattgatttgagactctacccccccccccccttttttttttttaaaatgcaagcatttcatgctgtaaatttccctcagcactgctttggctgcatctcatacattttaataggttgaattttgttgtcatttagacctgtgaattaaaaaaaaattcctttgacagacacttggtctgaccaatagattatttagatatatattgtttaatttctaaatgtttgaggatttttcttattgatttctggtttgattccattattgtcagataacatattgtatatgatttcagttcttttaaatttgttgaggttggttttatgacccagaatgttcagtttcttgctgagtgtttcatgagtgcttgaaaaaaatcatattctgctgttgttgggtagaatgagatgggtagtccaaataagtaggctatctagatatgtataatctgaaaatgttgagaataactttttacttttttttttttcagaattgctcctgcgttgctaagacaagcatcatatggcaccattaaaattgggatttaccaaagcttgaagcgcttattcgtagaacgtttagaaggtcagtatacttaccctcttttgaggtgatactcaaagggattgttgaaatcatgcttagtgagaaatgttggtcatgaggtgcctgagaatggaggagagtcactgcaaagacaaagtgagcttgttctaacttggaataaatctttgcagaggtgatatatgaattagagagacctgttcttcaaatttgtcccttttcctatcaacaaaaaaggcatgtgatcatcccaaaagaaacatggaacaatcttgtccagaaaattaatgctatcttcatcaataagaggacttcaactgtaaggcattttctagctggcaattttgataagcttttattaggcagaataattttaggctgttttctaaattctgatgtacctttggctaccttatgcatattcagcattatcatatgtctgtttgctgctgtagcattttccatcatgatactacactaaatggttattttaccacaggcctggggctgttggatgtttggggacagctggaaagcctttcggttagtaatgtcctttgaatcactttattgtcctaaagtcaactttttctgaagcctttttttggggattgtgaagggttctcttccacctctttctgaaatatttttctttcatagattcttcacttgggtttatttagtttctatttgtggggtcttcatggtgtgaaggagcggtaaagattgaatttcactatagaacaatgtgctctgtggtttctttgttcttttttctcactgaggagatttagttctaaatgattgctttttcatatttgactacagaaatattttataaattaacagaggctaggagagatctcaggcctatcaaaattaatattcaaataagttttttgtattagacgtaagattttctcttttaacattcagttcctgaatctttagagttgatgattacccagaaaaagacttaaaaagtatgttctttagatgtttgaaaaggtcgaaggggaaataccaccttctgaatttgtgtgtgggatactgatagttatgtagaagaaaaggacgtgttccagtgtcctttagaaataatgatgtttttagaaatgatttatattttacaagttttaatatattttagcactgaattgagatctagaaatatttgagtttctttattttcctaagctttttggttcatttctaaagtcatctctctaaccaagtttcccttcctccagtaggtcagtagtatgtactcaaactggtgcctaatacaagcagacctttctttttcttttccttttcacagatgaaactcttttaattaatatgatctgtggggtagtgtcaggagtgatatcttccactatagccaatcccaccgatgttctaaaggtaagagagatacagtgtgatttgaaaggagcataactttgagtcagatttgggttcagattcccactctgtcacttgccagctgtagaaccttgggcaaatcagttaactgcattaagcctcaatttcatcatttgaaaaatgaatataatacagtgtttataacatagagttgtaaaggattagcgataatatatatataaactgcctatcattgtacttggtgtagtagatgctcaataaatggcagtcagtttattatgatatgtgttaatccactggtcctcacactggggtatgcaagaccctataggttctttccaagggctatgcagttttataggaatcaatttccagatctcttacatccatttgtactccatcctaaaactggtacgagaatgaatctgttcataatagcccttactcaattttacaaaagaaatgtacgtccccacctattctaaatcttggtatggtatgttgacctgtggtataacctgggatgccaaacagaggggtaaactgaaatacagttcttggagaagcctattttagtaaccaatttgggtatcttaagtctgtaatgcctctgtctttccctgtcttattaatatttctattcagggtgagatttggctttaaacatggtatattttggcctgtattggaatattctgaattcagaaccagaatagtataggttggtggtgctgacttgttaagagtatagttggatttctttaaggttttttcaagtcacagactgaaacatttcttttaatataaattttcatcttatttcataaaatggtaaatattttctacttattaacgtatttaagcttatgattagttaaaagcactaaatataggattaaaataagtgaggggaacccaaagttttaacaaattattttaaggggattgcgagaaaaaagtaagaggacacatgcttttttaaatttgaccactagtgaaaccacaagtggctaggttagcaaaggagagatctatttattgcaattcagagaggggtttgagaacagagagaaagacatgaaaaacaacacacatgaaataaaccactggtggttgatggataaaaatatgagacagtctttctggactaaaatgatagtaatttacagaatttttatatcattttaggtttacagaacaagtttttttttcaccgtttattttagattcagggagtacatgtgcaggtttattacatgggtatattgtatgatgctcaggtttgggatatgaatgatcccatcacccagatagtgagcacagtacccaacagtttttcaacccttgtccccctccttctctcctgcctctattattccctggtgtctattgttgccatctttgtccatgagtatgcaatatttagctcccacttataagtgagaacatgctatctttggttttctgttcctgcattaattcatttaggataatggcctctggctcaatccatgttactgcaaaggacatgattttgttcttttttatgactgcatagtattccatggtgtatatgtaccacattttctttatccagtccaacggtggtgggcacctaggttgattccatgtctttgctattgtgaatagtgctgtgatgaacataggagtgtatgtgtctttttggtagaattatttattttcttttggatatatactcagtaatgggattgctgggttgaatggtagctctctgttttaagttccttgagaagtctccaaactgctttccaaagtggctgaactaatttacattcccaccaatggtgtctaagcattcccttttctctgcagcctcgccagcatctgttgtttttactttttaataataaccattctgactggtgtgagatggtatcttgttgtggtttgatttacatttctctgatgattagtgatattgtgcatctttttatgtttgttggctgcttgtatgtcttcttttgagaagtgtccgttcatgtcttttgcctactttttaatggagttatttggtttttgcttgttgaattaaattccttatagatgctggataccagattttcatcagatgcatagtttgtgaatattttctcccattctataggttgtttctttactctgttggtagtttcttttgttggaagaagatttttagtttaatcaggtcccgcttgtcaattttttgttttgttgcaattgcttttgatgacttagtcataaattatttcccaaggccaatgcccagaatggcgtttcctaggttttcttttaggattcttaaaatttgaggtcttacatttaaatctttaatctgtcttgagttaatttttgtatatggtgaaaggtaggggcccagttttattcttctgcatatagctagtcagctgtcccagtaccatttattgaatagggagtcctttccccatgcttatttttgttgacttagaacaggtatttatgaagagaatttaattgaagagctccttgtacctcttactctaagcagacaaccccacctcctatggcctggccttatacctctcaatttcgtgtcctttctaccttacaggtgtaaacttacttccatctatacccatccttatcttgtcttactgtagtggttttccagaccagaccagtattacctgggaacttgttagaaatgcaaattatcaggccccatccaacacctactgaaccagaaagggtaggatggggcccagcagtctggtttgacaagcccttcaagtgattttgatacatgctcaagtttaaaaaaaacctggttactctacttttattcacttctgtttcatcagagacctttatcatttgtcctctttctcttattttcagtgtcttcctctttaccggttatcttctctcaaatgataaatatggtcaaatctctctatcctaaaatattttcttgaccctctgacctcaaaacaccatgctatctcttttcttaccttctcatccagattttacaagagtaatctttacattccatttccttcataacctgctgtaatcactcctgctacttgattgaaatcactctccacagggtcagcagtaatgtcctcattatccaatccagtggacattttagttctcatcttacttaacctattttgactaattccttctactagaagttcttttttggttttgttactacactatttagattctgcttctagttttcctattccttagcttcattcatgggcttcctttttatgcatatactttaaatctttttcttctcccacccaaggttccatctttagctcttttctcctcttcagtctctccttgatggcctttttcattctttttttttttttttactattattattattttttttgagacggagtctcgctctgtctcccaggctggagtgcagtggcgcgatctcggctcactgcaagctccgcctcccgggttcacgccattctcctgcctcagcctcctgagtagctgggactacaggcgcccgccaccacacctggctaattttttgtacttttagtagagacggggtttcaccgtgttagccaggatggtgtcgatttcctgacctcgtgatccacccgccttggcctcccaaagtgctgggattacaggcgtgagccaccgtgcccgaccgcctttttcattcttaatactttagctctcactatatcagttaggttatgggctaagctactgtcacaaagaaactcaaaaataaaaggtctccatatacaagtatttatctctctcatgtaaccatctagaggactgcagttaatgctggtaaggcagaactacttcatgtagtcatccaggatccaggtttcttcatttttgttgcactgccatctcctagggcagggattggcaaactactgtctgtgggtcaaatctggcccaccccctgttgtgaataaagttttattggaacacagccaccccatttttttatttattgtctataattgcttttgtgcttcagtgacagagttgagtagtcacaacagaggtcataagccctgcaaagcctaatatatttactgtctggacccttacagaaaacgtttgttgacccctgtcctatggtattattttagtctgtatagttgaagttggaccactatcaaacctacattccagcccatgggaagagagtcaagggaaagcagtttccttttgatttgtcaaaaataaagtcaggaaaaattttaaagtttattgtatgcaataagagaaagtacgggtctcgatccaggatacttcaaaccaaatgataacaaacttatcttacagtacagtttataaagcagaagggcagaaacattttgaccttttttgtgattggctgttataaattatcgttcttttaaaggcaagcagctgtttaaggtgattgtctatagttattggtttcatttcactgaagcattctgacaaagatgtaaagcttatgttttgtgtttatgattagagatagcagttccgaggaaataggatgacttaaggttcggttacctgatgatgggtggctggtcttggggtttatctcaattgttgcctccatttttatctttaacagtttaaatctttaaatatgtagttttggagaaacaatttcaaacatatgagtgagtagaaaataacatagtacagtgaacgtctttgtacacatcacggaggtagctaagattttgctacatgtgcttttttattccctttttctgaattattttaaggcacattccagacattgtcattttcccccatatacttcgatgtgcatctcataaaaggaatatttttctatataaccatggtgctattgttacatttaacaaaattaacatttattcattagtaacatctaataatctatgttcacatttccagactgtcttatattttacagttgatttgtttaacttgggttccaaagcctatgcattatatttaatagttatgtttcttaagtcctttttattctagagtaccccactcctgtccatataccttttatttatttatttatttatttgctttttgccattaacttgtcaaataaatgggatcagctctcctttagaattcccaagttttggatttgtctttttgcttccttgtgatatcatttaacttatttctctaaatcttctctctctgtaaaagggaaggtttctgtaaaggtcataccgagtcatgtgaggaggcacacagtgtttggttgtcccaatatagggatgttaaggttgatcagtgggttcaggcgtgacagcccgatttctcctttgtagtttcctgtcaatccttcatctaatggtttcatccattggtggccattacctgaattgattgtttcatttaaggtcgcaaagtggtgattttctaattccatcattccatccatgtttcttagctagaattcttctgcaagggcaatctttttttttttttttttttttttttttgagatggagtctcgctctgttgcccaggctggagtgcaatggcatgatctcggctcactgcaacctccacttcctgggttcaagcaattctcctgcctcagcctctcgagtagctgggattacacaggtgcacaccaccacgcctggctaatttttgtatttttagtagagacggggtttcgccatgttggccaggctggtttcaaactactgacctcaggtgatccgcccacctcggcctcccaaagtgctgggattacaggcgtgagccactgcgcctggccaaggacaactttttctcatttagtggggctgtttggctgttctgaaatataggcaatttccttttaagcaagacactgggaagtttcaaccattatttctgttcacgttccattctgaaggacttggttccatggctacatctagcttcaagaaaggagagtagattttgggagacaataatctaccacactacccagacctactgggtcatctaaactagaaacctagatcatctttgattcttctatatctttgcttccttctagtattggattaggtatcaagtttctacagattttgcctcatctgtatttctcaactttgtcctttccccaccattccttttgtaggacctcatctcagtagcctcctaacttgtcccttcactctagtgtgtaccccactccctcaacccatctccagatgaagctggagagatctatcgaaatccatatctgatctactatgtactgcttctttgcctttgtgcacgtaacactttcttcctgaaacgtctttctcattttcctggtgaatttgtccttcaagaccaggctcataaacagggccaggactagggcaaaacaagtaaggcagtcccctttgatgcagaatgtaagaaggtgccacaaaactcagtaatcaatataaacaacatttgtatgtagtatttttaaacaatcaaaattaacgcaaaaaattcatgatgaaccaaataccaaaatttcacataactcatctcattcaccttaccctaatcctggccctgttgagtcctagctttagttaaatttgatatttgattcattatggctttttgtggattaattttggttaaaaaatatcatattgagacatcatttatcttgattactgagtttttcttgcactcccttacatttcatgcctaagaaaagtacttcacttgcctcacgctagcccctctgttgtcaggaatcacctccttaaagaagtgttctacttaccacagtgtattagtagttttcatttgtctttgtgataggttgtatcttgatttaatgggtttaggtttttataattataatatttgaaaactcttagtagtaacagttaactttctgcataaaagcatgttgccattacatgacttactaaagacatttgttgaaacctagaatggtagcatggtgcttcataaaaatcaggcctacatttgggccgctagtatttagtgactgactactaggattgtatgtgtgcagagtctgtgggaaattgtaccaaaccttttacatggccatttaatgctatctttccttcttgcagctctcaaaggccacttggcagaatataatattatgctttttataaatagaactcaacttaaggtctcataaacataaaattatattttaaaacacatttttcatttttataattacgtaagcaatgcatgtttaatgtagaaaaatatggaaggcagaaaaaacacaaaagagaaaaatgcttacttgtagcctcaccactcagacataaaccactgtaagtatttagttttatatgttcacctcgtctctttgctgtgcttatggatatttttaagtttacatgttttttataaaaatgatatagtacttcgcaattttttttctggttagcaattaatttttgatatctttcagtgtcagcaaataccattgtacaacaaaattttatggctccatagtattctattaaatgaatgtataatttctgtaaccaacctgtgtagttgtttttggatattaagttgtttctaatttttcactaaatgagtcattttttagtcctgctgagtacttgatctttcttttctccaaattttcttctagctccagaaataatagacttagtgtgaggaatgtgaggccgatgaaaaccatttttataaaatacactttgacacaaattctttttctatacagtttaactaattaactttatcataatagcagatatttttctgggattcctgaatacttctttttaaattttagatgaatttaaaatgaatttaaatgaacttaaaatgaatttagcattttggttctctctgacaaaataagatgttcacctcttttcattttagattcgaatgcaggctcaaggaagcttgttccaagggagcatgattggaagctttatcgatatataccaacaagaaggcaccaggggtctgtggagggtaagtactcttttcctgctattatcctacactctcagttcctacaatttgcagagaatttttttttatataaagacataaaatcgtgaattataatccaaaaactaaggtaagaaactcctcatctcccttgaaaggcccaaaacttatcattggccttttatttctgcataatgtttggggattatataggtggggaaagttattacattatttgagatggctgtttcgatcatattcacagtgaatgtagttgttcagtgtatttttttgcaagttctgtactaacacgatgatgtatgtctttgtagtgcttatgttcaaaagctgttaccggctgtgtgctgtggctcatgcctgtaatcccagcactttgggaggccaacgcgggtggatcacttgaggtcagaagttcaagaccagcctggccaacctggtgaaaccccatctcaactagaaatacaaaaattagccaggcatggtggtgcatggctgtagtcacagctactcaggaggctgaggcaggagaattgtttgaaccctggaggtggaggttgcagtgagccaagatcatgccactgcactccagcctaggtgacagggcgagactctgtctcaaaaaaaaaaaaaaaaaaaaaaagaataagaaaaaaaagctgttaccttaaacaattttttaacctaaaaagtctaacatgtactgtaaaatattgagaaaatatagaaaagtaaaaagaaaaaaaatccagtagtcccactgcctagagataatttctgttaaactttttgtcatattatctttcagtcttctatctatactttgcttttcgtcattgttgctctaactttttaatccctaattattgtaatattaataatattattagtagaatatacagagagagtggaatgggaaatctattaatagacttttaaataaaaatgagagctttggtatttttctttataatttttcataacaaaaatttcaagcataaagaaaaattgaaagaatagaactatgaaatacatacctatgagctggatttgatggctgttaaagtttgatcgtatttgctttatctgtttacgtgtatacagacatacactctttttagctaagctaaatgaaagtaggttgcagacatcatggcactcaattaaattcttcattgtgcatctcctaagaataaggatagtcttctacataataataataccattatcatatctaagaaaatgaacaagtccctaatacctaatatctagcccatattagaatttcctgttaatgagaccaggctaatttataatttattttcttccttcctccttttttttttttctttttttttttgacagggtctcactttgttgcctaggctggtcttgatcttctggcttcaagtgatcctctggccttggccttacagatgtgagccaccatgcctggccaggctagttttcttataaagtgtttcctcattgtgtttgtttctctatctttatagagaaaatatctttatatttacagtttatttcctataaactgtaaatagggtccattggcttgattagattcatgttaaacatttttggtaagggtgcttcataggtgatgctgtgtatttcatactgcatcacagcaggaggcacataatattagtttgtcccatgattagtggtgccaagtttgattatttggtaagatgacgtccaccagatctcgccattgtaaaacataagttttttccccctcctttgcaattagcaagtaatctgtggggtgataatattctagtaatatgcatatatcctaatatctaatcacctttcatctaactaatggtctttgcatccattaatggtccttgaggtttgctttttggtaacagcagggtacacttgcttgatatgtctaatttaaagccagaaaatagaactaactagaactttctcacaaactgatgacaaggaacaaaaacagaggaataaatagaattggagattttttcacaggagcatagctactttattttttattgtagtaaaaagtagacataacataaaatttaccatcttaaccatttttgatggttcagtagtgttaattaagtacattcacattgttgtacaactgatctccagaactctttaggtcttatcaaactgaaactctatacccatgaagcaactccccatttctccttcccctagcccctggcaacccccattctcttttgtgtctctatcaatttgactattataggtacttcatgtaagtggaatcacacaatatttatctttttgtgactggctgattttacttagcatgatgttctcaaggttcatccatgtggtagcatgtgtcagaatttcttcctttttaaggctgaataatattccattgtatgtatataccacattttgtttatccattcaaccattgatggacatttgaatggcttctgccttttgcctattgtgaataatgctgctgggtaaatgggtgtgcaaatatcttttttagaccctgctttcaattcttttggttatatagccgaaagtggaattgctggattatgtggtaaatctatgtttattttttgagaaactgaacataactgtttttatgatccaggctacttacatgatctaggcacctaacataaagaagcaaagtacattgttgaatgtattcttctgagacagacatgttttatttgcatgttaaaaatacaggacttactttttcatttcaacaagaaaatatgtttgcatttttcttcaaacgtgctcatctttgtttatcttcctgctctgattgtaacatgaatactgaaaacatttcactttcttcctaacttcattgtaagaaaaaatagcacgagcacaataacaaagtataactagcacttaccacagagttggagagagagtagcatggtggggactgtggtcctggagagcacggagagcacagtccccgttgagagaggacagctactccttagctccagcccattgctgccatgcgttgatggtgagcccggtgtggtcaaattttctggcctttcaagagaagctggaaatctgcatttctgtgtgaaatatcctgatttttacatattaacagccaattcagtcttttggaaacactgtgggccactcgaaacatgcctatagcctgattttggcctgtgggctccagtttggggccttactgttcaccaaagcagtcttctgtgaagggtaccctctttatgagaagcaggtcaaagagccagcaaggaaggcacccttcggctagccagccatatcagcacaatcaaacatcttggcatagctgtgtcacttccacttcattttatttatttatttatttatttatttatttatttatttatttatttattttttgagacggagtcttgctatgttgccaggctggagtgcagtggcgcgatctcggctcactgcaacctccgcctcctgggttcaagcgattctcctgcctcagcctcctgtgtagctgggattattattattatttttttaagtgaaagcaagtttattaagtaaaggaataaagaatggctactccataggcagagcagccccactttataaattgagtttgggaacttagagatgactgaaaactttttaatatagtggttatcccagaaagcagatgtcctcatggtatgttattttcaattttaactgacacctaaacacagttataaaagtaaaacattcattgtgaaaatgtaaaaagaaataggcataaaaatgaaaattaacatctcttatcctaataccagaggaaaaaaatattttgatgtatttcgttctaatcctaagaatttggcctggtgtgtataccttttcccctgaagatagaataatactatatataattttatgccttgctttatttaacatgctatcatgctatcataagcgttttcttgtgtcattaatattcttcaaaaatgtgacttttaatgctctagcaaccctgtgttgtaatgtgagctgtgataggagcatcgtgctagtgagtgaaaccctggtaatgttaccacagcaggacttgtaagcgaaggaccactttcccttggcttttcctcttgcttcttcatacctttgctgtcaccttagtgtttgtcctttctgcacatctgaaaattctgtgaattaaacctgaaagctctcttctccccactgatttttgcttcatgattttatttataacagctttattgggaaaattcacatattataatgataattcccaaattctttattgagataattcacataaaattcaccatctttaaagtatacgatttaattgtttctagtatattcacagattagtgcagccattaccactgtctaagtttagaacattttcattaccaaaaagaaacccttaccctttacccatcacttctcatttcccccagccctcctagctgtggacaaccactaatctactttctgtctctatagatttacctgttctaggtatttcatgtaaatggaatcacgcaatatgtagactttcgtgactggcttcttccatttagcatactgattttaaggtttatccatgttgcagcatgtatcagtactttattcctttttatgggtgaatattaattccattgtgtgggtataccacattgtatttgtcccttcatcaattaatgagcatttgggttctttgcacattttggctattatgaatactgctatgaacatttctgtacacatttttgtatgaacatctattttcagttctcttgggtatatacctaggtgtagaattgctcgctcatatggtaatctgtgtttaactttttgaggaagtgccaaattgttttccacagtggctgccccattttacattcccactgacagcatataagggttcctatttcttcacatcctcaccaacacttgctcttttactttttctttcttaatttttttaaatttttttttgaggcaggatcttgctgtgttgcccaagctggaatgcagtggtgcaatcatggctcactgcagcctcagcctcccaggctcgggtgatcctcccacctcagcatctcaagtagctgggactacaggcacatgccaccatgcctggctaatttaaaaaatttttttaagagatagagtcttactgtattgcccaggtttgtctagaactcctcctcaagtgatcctcctgcctcaccctctcaaagtgctgggattacaggcatgagcccctgtgcctggccttcttttacttaaaagaaaaatcgttatagccatcctagtaggtatgaagtggtatgtccttgtggttttgatttgcatttctctagtgactaatgatgtttagcatcttttcgtgtgcttattggccatttgtgtatcttttttgaaggaaatatcttcaggtcttttggccattttaaaattggattgtttgccttttttgttgtaagagttatttatatattcttgacactagtcccttatcagatatatgagcggcaaatgtttttttcctttgtgtatgttgactcttcactttctgagtggtgtcttttgagtcataaaagtttttaattgtgatgaagtccagttgatcttttttttttcttttgtcttttgtgctttgggtgtcatatcaattattttatttttagtatagcaagtgaattggaaatttgtatatgttccattattagtcattgatttgaaagagtgacgtctgtacttcagacttgtatttttctgttacttttcaactcctgacctattttgttcactctaagacatcactccctttgtatttccttggtgcctaatgtcacttgtgtttcgtagggtgtggttccaactgctcagcgtgctgccatcgttgtaggagtagagctaccagtctatgatattactaagaagcatttaatattgtcaggaatgatgggcgatacaattttaactcacttcgtgtaagtaggatgggatgtgctcattttatttccagcattttgagcacaaaaagcctcttttactgaaatcctcaggtggaatttgataactggtacgtatggcctaaattcccttgtctctcctattatcagaacttcaagccttatgaacactttatacttcacagaaatgccaggtgctatgggggcttgggtacttgggaacattgtctaatacagcagcctatcagaggtctatttgatttacatttatccatacatagcttctatatctaataagcacatctattatttgctttggttaattttgtttgagaaagcaaacttttctcagtgggaatcagaaaaaaaggggtaaataaggtctgtgaaactaaagcacagttttttggctaaagactgttactgatctcattttacattttctttgtcttgcaacctttatgataattttgttactcaaatgcatttggcatgtgatgctgtggtttgaaaaatttatgtaactaatacatggtgcatgatactttctacttaggaatcttgttaggtttagaaactctcctttaaaaaaaaggctgagtttcagattgaaaattgaagggacagcctttgaatgatgtctctttagaaaaatttcctgtctctttagattgtaacgaaaggccaagtgccaggttttatctgatgggtctgagttatattgtacagtttacgtttggcctaatttctgtttaagtgggcagggagtgaaagtggggtcgatctacttaaacttttcctcttagttccagctttacatgtggtttggctggggctctggcctccaacccggttgatgtggttcgaactcgcatgatgaaccagagggcaatcgtgggacatgtggatctctataagggcactgttgatggtattttaaaggtaagtacattgtggatttgggttacaatttggctttctttgatgtcttagaccttccttcagttcttattattagttgctacataccattttgaagatgaaagaatcatatttttttagtagcttctcagttattcccaggtagaaaagctgtctccttagcaatctgctaatttgcagtggtacttaatataatgattcccatttgaatgctttaaaatacaggatgcttttattaatagtatcatgtagaattattgatagaaaagacaatatatcccccatttgcctacttcatacaacacagagaccctgcaatagaaaactcaatacttaaggaaaaaagcctgtattttatttcagttcacggttatgctgttgttcactttggctttgaaagttcctgctgttgtgtttgtgggaactgaatattctaaaagtattacatcattactggtgatattattgctactgaaaacaaattgaggctaaaatatgatgttgccatatggtttctctcctgttatcagttttgtttaacaactattacatattagacaccattttagtagttagagagaaattacagttattacaaaagtactataggtatacaaacggatcatcagtacagcctgataagtgataaactcaagagttctcaatttggaagcattgaggtaggctccctgtagatggtggcatcttgaataacaataactcatatccactgagtgcttttttgtgtgtcagcaactgtccttatgagacttatgtgtattcgttcattgaatcctcaccattactccacgaggtagacactgaagcactgaaagattaagtaagctgcctaaggtttcacagctactaagtgggagaactggaatttaaactcagatcacttgacctcaaactgacatttacctctccactatggtgctttcctcatattggtggccaagggttagattataaaggatactgaatgctatattgaggtgcttggacttttttttaacttgtcagggagctgttgaaagtttttaatcagattagctttgcattttaaatagattactttggctttatggagactggatctaccacagtggttcctcatcttgggtacacattggaatcacttgggagaactttcgcagctccctcctctaccttagaccaattaactcagaacctggggagtaaggtccaggtgtcaatattttaaactatatcaggtgactgcaatgttcacctaaggttgaagactactaaggggataagcctggagccatggttcttcaaagtttaacatgcatcagaattacctggagggcttgttaaactgcagttcacttggagccatctccagattctgatttagtaagtatggagtgggacctggaaatttgcatttttaataaattcccaggcaatactgatgttgctagtctggagaccacacttggagaaccactgacctacagatagggaagctgattagaaggctcttgtaatctgagaaagaggggatgaaggcctgaacttgagcatgataatggagatatagaaggtgggacagagtcaagaaagaattagttgatagagtcagcaggatttgattgactggatgtggaggggtgtgggagaaaagaggtgtcaaagataagttctgggtttttggagttggtgaccaggtggtgacattcattgacagaggcatcacaagaggagcacgtcttgggggagacatcctagttttggatactcagtttgatgtgcatgaggaaaatccagtggatacatatggatattctagccctgactcaagagagggttcatggatatagataaaagcccatggagtcattagcacacaggtggtatataactgtggagagagttgaccaaggagagtaggtagaggagttcacaacctttttgccttcccagcatactggagtactataaaattctttcccgtaataatgattgcctggggcagcaattctcagaccctggaaagtatagtttggcaaaagcccccattggtatttctgcatttgacaattactggtgtagagggaagagcactgggccaaggaaaaaacactgcagaataccaatttttatttatttatttatgcccaggctggagtgcaatggcgtgatctctgctcactgcaatctctgcctcccgtgttcaagcaattctcctgcctcagcctcctgagtagctgggattacaggtgcccgccactacgcctggcttatttttgtttttagtagagacagggttgcaccatgttggtcaggctggtctcgaactcctaacctcgtgatccacccgccttggcctcccaaagtattgggattacaggcgtgagccaccgtgccctgaccggaataccaatttttaaggtcttggcagatgaggaacctaggaaagacaccaaagacgaggaaacttagagagtagtgtcatgggagccaaagaagttaatgagtttcaagaaggaatgagtggttacttaatgtcacatgcaatagcgatctaatatgataaggactgcaaagagtctgttggatttaatattttttagaaggtttggtgaattggtgtttgcaaaagccaattgctgtgcattgaggaatatgtttgattattcattcaagtaataaaaaagaaaaaatcaagctgactcttgaagaggcccccccacacacacacaaaagaaagaaatgtttgtcttatgtgctaagcactgttctaggttgttgaggatgtactggtaaaccaaaatgtccctgtgtttatgacacttagattctaatagaaggagataaacacaggaagtaatgataaatagacaaatgtaaagcactgtttcaagaagattggctaaaagatttactgtaagatttactatacaataatatagtaatagctaatgtttattgaatgcttattctatcgcaggcactgtacatagagtatatcctttaactctcacagcgaccttgtggagtagatattatctttcccattttataaaggaggaaacttaggttcagagtagctaagtaataacttacacaagattacacagctaataagaggcaggtctgagacttaatccacaatctgtctgattccaaagtttgtacttacagccactatgctgttctgaatctgcagaaacatgtttttatgttggtagtaacctttaagtacttacatttgctcactcatttactcacttgctactaaaaaattttaatagcagtcattctttaaaatgactttgttctattttgccatttatgtaatagcatcagactttattattttgtctatgcttatctatagaagttctttgttttcacacaactgccttatgccaaaagatgcctcccagttctcacgttgtgaagaaattggtcactgtttttggaaatttataaagattcaagccgggtgctgtggcttgcatcctgtagtcttagctactcgggaggatcgcttgagccagagtttgaggctgcagtgagctatgtagtcttgccactgcactccagtctaggcgacagagcaagaccatgtttcttaattaaaaaaaaaaagatccagatggctcacaagagtgttagagacccttactgtttttgtgttcacctcttcaacaaatacttacgggaaaatttcttgcaccagacactgtgttaggtggtggtgacacaatggtgaacaaacaaagctagtttctaatctcttggagatttcattctagttgagggagacaataaacacacaatgcacagtataattttagatagaaatagatgctatgcagaaaataacagcatattgcaatagtgactcagtagtggggaactacttcagcaaggatggtcaagaaaagcctctgaggaggtgacatttgagctgagatctgaatgatgatgagctggccatgagagctgggagaaaaccatttcataaagagggaataggttactgaaggcctgagttggaaataagctggacatgttcaagggttagaaagaaagctagtgtggctgagtgtgtggtgaatgaagggagaaactagtaggaaatgaaactggagagaaaggcagcagctaaatcatgtgggatcctataggtctttgcagagactttgtaattagaatgaaatccaccaggaagccatttgagagctttaagcaggaaatgttatgctctcatttataattttaaaagattgttctagcttctaggtagagattttagaccaattaaaagtccattgtggtagtccaggtaagagattatgagattggatggtctttcagaggtctcttgtcatttaacagtctaggttctaggttattcacatctgggctttatttggggtgattttcacaattttccaacatcagttttggtctcagacctttactatttgctgaagatccattgggggaaacatattaccactatatcttcataaatattgtgcttattattttactgtttgttcccaaaagtagttagtaaggataattatctctagtatacttaatgtacaggatgggaaaaagaatatttacaactctggcttctcatattattgtcttatccaaatatatcctttttttagaattgtggtgggtttcacttcactattggaaaggcaaaataacatttttcaatgtctaacacaatgcctaacacactgtagttatgtaatagatatttgtccattatatacgaaccatttctgctggctaaattcagcacgtgccaccagtttacaacgtttatgcataatttatcatttaattctcataaccatgtatataagacccctgttgtataaagtaggaaaccaaaactcaaaacacttcacatttttcttcatgtaatcctcaaagcattcacatgaggtaggctatggcattatatagaatttataatgatgaaacagactcagagaagaataatgacttgcccaactttctattttcttaccctgctttagttctctttgtggcacttatttttggatataatatatatcaatttgtgtatttgtcagccccactagaatatgcactccatgagggtagaaactgctgtataggttacctattgctgtgtaacaaattactccaaaactcattgccttaaaccatttgttattttgcagtttctgtgggccagggattgcaaagcagcttagctgagttgattctggcttaggctgtctcctgaggttgtagttcatatggcaactagggttgctgccatctaaagccttgacaggctgggatagctgcttcagtgatcactcatgcagttgttggctggagccctcagttcctcaccatgtagtcctctcttcatgatatagcagatggtttcctctagagtgaatgaatccaagagagaataaggcagatgctttattatatataaaatatattttataacctagctatggaagtgacatatgttcactactaccatattctgttggtgacacagaccaaatactatggggtggaggctacgcaagggtacaaataactggaggtagggttcattgggggccatcttggaggctggctaccatagacactttttctgtcttgtttattagtatattctcaacatcaagaatggtgctttgcatatgtatggtaggtaaatatttattgattaagtgggtggatggatttagactacagatgaatttaaaatggacctttagagaaaagactattcatggagccataagttgccctggggtgggagtggaaggtgatgtcaaatgtagagaaaggtgaattcactctgtttttggttatatctttcctgcagatgtggaaacatgagggcttttttgcactctataaaggattttggccaaactggcttcggcttggaccctggaacatcattgtatcctttgagagaatgaaagcaagtgcttcaagctcccagataattctaggctatgggaaggaaaatttgattattaaagccttttaggctagtgagaaactcaagcatcccattggtgacccttgagaatcaaattaagcaaagaaacagctttcagttggaggctaatacaaactaaaagggatagaaaagatatgtcaaactttactctttaaaacaaaatgacaacaaacacagctaatctggaaggggctatgaagtttttagaaaccctgatggacgaagcctacaggaaagtccatgctgaggtggttcagatttcctacccctaactataggaccaaaatagctgggaaataaaaacaggacagaagacattcatggggtgaaggaatccacagccaagcaggcttctttcttcatgggtgaatctgtctcctccagttgtgtttgagtgcctcctaagtgcagagccatgtattggatactgtgtgtggtgttgtgtgtataatggtaagcaccgcagggttggaaagtaattctctgcccttgtggggtctgtagacagagagagggtatctcgttccctcttggaatcactctgatcatctaattaattatatgtcgtcactgatgttcttggttactgtgtgtgtgtgcgtgtgtgcgtttgtcctgtttccccctgaagactataaatatattagagttttactctgtttatgttgttcgatgccagtgatctgaatgggcacatggtaggcactcaatgcatgcttgatttgacaggtggtgttttatttatttatttatttatttttatttttttttttgagatggagtcttgctctctcgcccaggctggagtgcagtggcgcgatctcggctcactgcaaactccacctcctgagttcacgccattctcctgcctcagcctcccgagtagctgggactacaggcacccgccaccacacccggctaattttttgtatttttagtagagacagggtttcaccatgtcagccaggatggtctcgatctcctgacctcgtgatccacccacctcggcctctcaaagtgctgggattacaggcgtgagccaccgcgcccggctgtcaggtggtgttttagaaaagattttaaagcagatgcagcttggaatagcatagactaccttaatttaagagaatgcgatgctaattttagaactagctttggctttcgatatcaacctggtgatcttccttgacttactcctcagttttttattacatacgagcagctaaagaggcttcaaatctaagaactgaattatatgtgagcccagccctgccagcctttctactcctttgcccttttcccgtgttctaatgtattttgacaatgttgtaagtgtttaccaagccgttggtctcctaagggcctcctgatggaagaacagtggggtggttcaaagttatttctatgtttgtgttaccatgttaacttttccccgagagaaagtgttaacattgagactctggccccagattggtatcttctatgaagatggatactgatgggtgacattgaaaacggcctgctttccaaatgtggttaaatgtaattggttagccccagacttgggctagagcagaaggcataggccagggtggttattgctatatgtgttacagacctcggttctcattaaagtatttattggcagaa

SEQ ID NO: 978 - DNA, 8668 bp, mus musculus
gtattctcccagtatgggcgggactggaggaagccaccaaccaacgaagtactgggcctgtgggtattcgtctctctccccgcccctgagagtctgggaaaggctgacacgtggtgccttcaggctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcaggtacattgtaaagaagcatgattatttctagaaatgcaaaaacatgtggcaagattttaaaacctgtcattattctaaagaatacttaatgagatttgaagagcattcaagttacaaatgaggaaaacttgttttagcattcaaagtacaagagaatttgaacattttttaagtgtatattatttgtgcaaagtgaagatataagaatgtatggcaaggatatttttaagtggctatttcttgttgtgattgaagtaccgtttactttctacttataatttcttaaaatctaaacggtgccaacagtgggtgtaacttttgtaatttcttgaaatagaaaggtcttctagagtaagatacaaaaaaaatccaagcactcaaatatacattgtcattcatgtatgcaaatggtataaggtggtgttgaagaatttgtgcaaaactgtatccagtttgcattcaattgtctttaaagaaaaggatagtccatgctcccagaggctgaataaaaataaataaataaagagaagtaaatatatatataataggtgcaatcattttcttttccctctaggcctgtaaccaggtaacttggacctatctatctaatgcttatacatatatatgcattatgcatatcatgcataatcatggtcagtgttagagtgagtatgcgtttcaactttatagattttacataaaattttaagataaaattttggtataagttttgaaaaatataaacaaaagaaaccctaatgttctgaggcataagcacatagtgcctgttccaatgttagcatgtatatatatatatatatatagtcagcatactaatgattaggtaaggcaggtatcaaaattaagatacttgagtggtggcattataggtattatgtcctgtgtataaattttttaaaaattgagaacctaacattctttaatgaattagtcaatcaagaagctcattgcaaatattttattatctaaaatccaggtcttgcaaatatttcatgacaatttcagttacccaggaatgagcagtgaaaagtttgcatctaaaacatgatgcatatataaatttaatttaaatatgcttattgtagtgtattaccgtaaatatagacctctgtgcatgttgaaataatgggagtaaatatgcaaaaggctattagtgtttaatacaagattttatgacagtgcttttgttcttgatcagcacatggttattttctaaattctttacaagcaccatgtcttaattacttatgaggaaacaccataagactgattcctaagcttaagcagtggcacacacatatataataaagccataggaagccattaaaagtcaaataatgatgtgcatgggaacttgcttgtgttttaatgttgaatgatggaaccataagacaaaatcatgttcctttctactggaattttgtaagtttggagtgtgtgtgtcaccccaagagggatattgtatggaattcagccttgagatctatctggaccctcctattagggttctgacatggctgcccccaactcaatacacaagacctagtgcccaggtcagaaaatggaggactcccagggaacctggcagtgaaacaagtcacatggcctggtgcctagatttgttcttctctaggctgttatttccattattttcttcactttcttagccctaggtccctaagaatttcccactgaagcagataacttgggaaattgttggggatcaaggttgaatgaagaagagcagacctacaaagctatggtagagtggaaatgggcatttttttgtttttttaaattttattattattatactttaagttttagggtacatgtgcacaatgagcaggttagttacatatgtatacatgtgccatgctggtgtgctgcacccattaactcgtcatttagcattaggtatatctcctaatgctatcggaaatgggattctttaaacaaagtatggctgatgaaactgggtggtataggcttcagtctgagttcagagggaaaccaggagcaaaagtaaattcgaaagagcagattttccccaaacagggccaatagcaaggcagctttgtttcctgtctcctttgtcttggtagcttttttcagattgaatgggtgagaggagaagggctctgggggtggggtgcccaggcaaggctaatcagcttttccagagcaatactgccatcaagaggatgtagtttgacaaaacacaaacccaaagttgttagagcccccccaagttttagcaactgagaaatgttgggccttttgtgaggttgagtggaccctagccctaagtaggtccccttcactttaaatctgaagccttccaggagctctggacaaaggcaggatcctgggggagaagctgataagtggggggtcagggggaggactgaagggacagctactaggcaggtggagtataggaagtattggggcttagatatctacccagtgagggtggggctaaaacaaatggctcagatcctatttggggggacttctggccacatatcctctggccatgccctttgaacaatgaggtagggggttggcacaaggtgtaagcaatgttagggtgcagatgaaacatctcattccagatgatatctaacagcagccagcgtgctttctgggggtctcaaggatacctaaaagtctggtgcccccattgcctagagcaaggaagacctgaggagaaggcagtgtgtgtcacttggccaagccaataaatccttgaacatcaataggagtgcagatatacacaaccagaagacctggaagtattttctgaagccaggaggtaacagctaccatggctttgcagcactttttctagggcccagtgtgaaggcctacctatttagagaaacctactcttagctctattaaaggaacagaaatgagttctttagctattggccttcccctaaggaagatgaggccattgagacttgggacctaactgttcattcagattagcaagtattgttctctgtgcctgcttcttagcctttttctaatgaagattccttgtaagccctctaaaagctgagcacatcaggaccctcaggacacttgcccatagcatagcaagaaaaggcaaaaattttgtaagattgactgcatgtgagagttttctcgtgtatcagtgatggattcagtggctgaccacttacagaagagaaaggaatgttattctcatgcactgctgtaacatatggtcaccacctgaattctacttgcccagggtggagctataacatctactaggaagtttttagcaactactacaaagaccatagggtccctggggaaattgactttcctgctattcatgccttggtctagctgtccttgaggatgttataggttgacatgagccaagaagggtttgaaaacatttgagaaagcatgtctcaatggtctcaaataccttatgaaagtgtaaggtgacctctgaccttttcagcctacttcagctaagcaggtgactgagagaaaccctgcatcagatgggttaggctgcctgctgttgagtcacagtttgacttgaccatatgctagactaggaaagccagatgtgtggagacagtgcaccataacttaacttagaattgtgagtgacagagaggtagccccagccctagaattcctcagggtcaggaattttgtattcccacacattttggtttacattaagagactatctggtcagagagtggatagaggcctaaagcagcagcaacttgctgagtcccaggaattcaaacgtgacaccgtgaccaggaatgggagattataactattgccaactctcaataccactcaatcattgacagtcagctcagatcaaaagctgtttcaaaatgtagttaaaaagaaaaccactcagcaggaaagatggcaaaggaataaggcacctctattatcacagtctcaaattcaccagtactgaagtaaattgcagttcactgtattcttccataatgcccttaaatcttcatcataaccccgagcaagcctttgaaaaggaatccattgatgtcagtgtttgtgtaatgatttgtagaattggacaaggtcctaccaggtgagaagcactgttaattggtacacctctttgaaggtcaacaggccaaatcatttaacctttcacatgagcataccctttgtccagagactacctcttgaaagtgatcgcacagccaaactcccacaggaaagtagaaaggagaggacaaagaggatcgctgagatttcttttgcaaggatggcggtggggagggggcaaaacatccattgtccaagttcaactacagtaagttcagctatagtaggtagtctttttaagcctttggaaagattgaaatccattcgccaagtcctcaataggggagatgaccacacctctgatttagggaagaaaatgtgaaatgttgtaacgggaatcaaaccattctggttggctaatagcaaggaaatagaaatgaaagatgaagtctttctttctctcttaattacatatgttattaattcaagttgaacacataaacctattggttcagaaaagcaaataggcagaaaggaagttatctggaaagttccccagtcaagcaactaacagtgtgtaattttctacagtgatgtttctaatgacttgccttcacgttttaacttacacttgtccaaagccttgaaatgttgaaaatgagaaaagcttacatttgcaagttttttaaaaatcaagaaaccagcatcatctcaatatataattaggaaaacaacatattacaagatgtatttttctttaaaacatacacacttctacacacatgcaagatttaaaggctctattctgaaattctatttccaaattttacttaacagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatgtaagtaaaaagtcaccaaatcctgacaacctgtccacatgtgcccacacatgtacaattatataataaaaagagcagaatgcaatataacaaacatcaatggaatatctattaaacttcttaagagtatcatttctttactgctatatatttgttccacttactgatttttttccagatgcatataattcttacggtttgatcaacagtaaaagaatgctatgagatttaaccataaaaaactatcttgttcctcaagaaaagttaatgatattggagagtactcattttctagtgttgaattgagaattcagggcaccaaattctatgtgtagtgggaccaatgaggatggatttgaagaaaagaaatggaagtgtgtgtgtgtgtgtgtgtgtgtgtgtgtgtgtgtgtgtgtgcgcgcgcgcgcgcgcctagcattgtgctgaggaatgtggggagtatattaatgagatatagattaaatttatttcactgaataacatcagttcttattgaacagttatatatcatttttttaatgtttaaaccaatatactcatcaagctgctaatagtggatgcctcaaaaaagtgggatttgtgataaagtgtttccatttgttcttcatagattgtgtattctaagagatttttcaagaagctgataagatatttgtaatttgagagtcaacccagaacaaatatgtgcagaagaaattgttggtgaaaacttgatttgttggctatttgagacctaatatatttatatatttaactgatcacagaaaacaggtgtattcaagacacccacattttaaaaatccttatctgcttcagtgggcattacttgtggcctcactgcacttctttgtacaaggctaatgtgtctggttattttgtaaacaggtatgcttaattttaggaaatgcaaaaatatgagaagcaaccttaaaaatattgcatattccaaggagtagttaatgatgtttccaaagacctcaaactgtcctgagaaaagcatgtctgacatacaaggtaactgggattttaggttaaaaaatgtacattatatatggatagggaagataagagaatgtatggcaaagacattttaaaagttatttcttctagttttcattgagataccatttatttttggctttgtaatttcttaaaatatgagcagatttccaacagcagatgttacctttataattccttcgaagagaaacctccttgtacaatcaagtataaagaaatttccagctagggaaaatagatgttgatatatggaaacatgcaatttatgtaagttggtgcagaagactttgtataaaactatgcccagtataagtcaagttataattaaggtgaaataaatgtgcacatatatgtatagcaatattatatattatatatgccatatttaaactataataaatggagcaataagaaacatttttgtttgtttgtttgtttgttttttgagacgaagtctcgttctgtagcccaggctggagtgcagtggcgtgatctcagctcacggcaacttccggcctcctgggttcaagtggttcttctgcctcagcctccagagtagctgggattacaggcgcgcgccactgcaccgggctaattttttgtatttttagtagagacgggatttcaccatgttggccaggctggtcttgaactcccgacctcaggtaatcagcccgcctcggcctcccaaagtgctaggattacaggcgtgagccactgcgcccagccaagaaacatttttttgcagtgttttgattactaaacatgaagacaaaaattttatgtaatgtggccaaactgtctgagaatcaggagtggcaatctcctaggcaaaccatcatgtacaaacaaccaattttaatataaattcattgtcacatatgaacataaatataaaactctgtgtgtattgaaaggagtaagaggacatgatccaaaaagttatcagtggtcttaatcaattttatgacagcgctttactctttatcagtgcatggttatttctgaatccttggcaaacatcatgtcttaattactaatgaggaagtggttttaaggcttatctctaagagataaatggtaaatacagatataaagataaatacacacacacacacacacacacacacacacatgtccctacatatccaataaagtggtaggaagcaattggagaccacttaatggcatcggaaagtgtcttcaaatggtaaatgaaatcacaagacaaaactcttggaatgggagctacttgggcgcttctcttaagactccagccaaatggctgccaacaagtcaacacataagacttagatctctatcctgaaaatatagaattccttgggagccttacagatggatgagccaggcaaggacatgtggtttggtacttagagataacctcccggccttgagtttgtagcattttctttttctgcttaggcctggattcttgagtcttgaatccagaagcagacaacgtgataacttgggaaaatactggagatgtatgctgagtgagcgagaacacaactgtgaaagctaaacctattggaaatgcagttcttaaaaagagaaggcctcagtttcgtttcaaatggaaaccaaaagcaacagtgcagcagcgtgataagattgtcccaaactgggcaaaagtaaggctgccatgtttcctggcgcctttttcttgctggtgtttttttggacagaaagggcgggagaaggactagggagcggtacttgttggcatatctggagcacgactgccatcgtgaggaaatagttttaaaataccctacgccattacagcgtccgtcccgtgaggtctttcggtttagaaacgcccgttcagcggagagattgaacaggccctgacccgaaattgggcttccctgacttctctgaattattccgggagctctgggcaaagacttgatgctaatatgacaaaggtgatatccaagtgtaaaaacctgttgttggcgaggccggacagagccaacagctgccagaagtccgggcacaggaagttgtcgggtggggcttccgttgaggaaaactttcagggcccagtgcagggcttgtgcccattgtctcctg

SEQ ID NO: 979 - DNA, 8667 bp, mus musculus
tattctcccagtatgggcgggactggaggaagccaccaaccaacgaagtactgggcctgtgggtattcgtctctctccccgcccctgagagtctgggaaaggctgacacgtggtgccttcaggctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcaggtacattgtaaagaagcatgattatttctagaaatgcaaaaacatgtggcaagattttaaaacctgtcattattctaaagaatacttaatgagatttgaagagcattcaagttacaaatgaggaaaacttgttttagcattcaaagtacaagagaatttgaacattttttaagtgtatattatttgtgcaaagtgaagatataagaatgtatggcaaggatatttttaagtggctatttcttgttgtgattgaagtaccgtttactttctacttataatttcttaaaatctaaacggtgccaacagtgggtgtaacttttgtaatttcttgaaatagaaaggtcttctagagtaagatacaaaaaaaatccaagcactcaaatatacattgtcattcatgtatgcaaatggtataaggtggtgttgaagaatttgtgcaaaactgtatccagtttgcattcaattgtctttaaagaaaaggatagtccatgctcccagaggctgaataaaaataaataaataaagagaagtaaatatatatataataggtgcaatcattttcttttccctctaggcctgtaaccaggtaacttggacctatctatctaatgcttatacatatatatgcattatgcatatcatgcataatcatggtcagtgttagagtgagtatgcgtttcaactttatagattttacataaaattttaagataaaattttggtataagttttgaaaaatataaacaaaagaaaccctaatgttctgaggcataagcacatagtgcctgttccaatgttagcatgtatatatatatatatatatagtcagcatactaatgattaggtaaggcaggtatcaaaattaagatacttgagtggtggcattataggtattatgtcctgtgtataaattttttaaaaattgagaacctaacattctttaatgaattagtcaatcaagaagctcattgcaaatattttattatctaaaatccaggtcttgcaaatatttcatgacaatttcagttacccaggaatgagcagtgaaaagtttgcatctaaaacatgatgcatatataaatttaatttaaatatgcttattgtagtgtattaccgtaaatatagacctctgtgcatgttgaaataatgggagtaaatatgcaaaaggctattagtgtttaatacaagattttatgacagtgcttttgttcttgatcagcacatggttattttctaaattctttacaagcaccatgtcttaattacttatgaggaaacaccataagactgattcctaagcttaagcagtggcacacacatatataataaagccataggaagccattaaaagtcaaataatgatgtgcatgggaacttgcttgtgttttaatgttgaatgatggaaccataagacaaaatcatgttcctttctactggaattttgtaagtttggagtgtgtgtgtcaccccaagagggatattgtatggaattcagccttgagatctatctggaccctcctattagggttctgacatggctgcccccaactcaatacacaagacctagtgcccaggtcagaaaatggaggactcccagggaacctggcagtgaaacaagtcacatggcctggtgcctagatttgttcttctctaggctgttatttccattattttcttcactttcttagccctaggtccctaagaatttcccactgaagcagataacttgggaaattgttggggatcaaggttgaatgaagaagagcagacctacaaagctatggtagagtggaaatgggcatttttttgtttttttaaattttattattattatactttaagttttagggtacatgtgcacaatgagcaggttagttacatatgtatacatgtgccatgctggtgtgctgcacccattaactcgtcatttagcattaggtatatctcctaatgctatcggaaatgggattctttaaacaaagtatggctgatgaaactgggtggtataggcttcagtctgagttcagagggaaaccaggagcaaaagtaaattcgaaagagcagattttccccaaacagggccaatagcaaggcagctttgtttcctgtctcctttgtcttggtagcttttttcagattgaatgggtgagaggagaagggctctgggggtggggtgcccaggcaaggctaatcagcttttccagagcaatactgccatcaagaggatgtagtttgacaaaacacaaacccaaagttgttagagcccccccaagttttagcaactgagaaatgttgggccttttgtgaggttgagtggaccctagccctaagtaggtccccttcactttaaatctgaagccttccaggagctctggacaaaggcaggatcctgggggagaagctgataagtggggggtcagggggaggactgaagggacagctactaggcaggtggagtataggaagtattggggcttagatatctacccagtgagggtggggctaaaacaaatggctcagatcctatttggggggacttctggccacatatcctctggccatgccctttgaacaatgaggtagggggttggcacaaggtgtaagcaatgttagggtgcagatgaaacatctcattccagatgatatctaacagcagccagcgtgctttctgggggtctcaaggatacctaaaagtctggtgcccccattgcctagagcaaggaagacctgaggagaaggcagtgtgtgtcacttggccaagccaataaatccttgaacatcaataggagtgcagatatacacaaccagaagacctggaagtattttctgaagccaggaggtaacagctaccatggctttgcagcactttttctagggcccagtgtgaaggcctacctatttagagaaacctactcttagctctattaaaggaacagaaatgagttctttagctattggccttcccctaaggaagatgaggccattgagacttgggacctaactgttcattcagattagcaagtattgttctctgtgcctgcttcttagcctttttctaatgaagattccttgtaagccctctaaaagctgagcacatcaggaccctcaggacacttgcccatagcatagcaagaaaaggcaaaaattttgtaagattgactgcatgtgagagttttctcgtgtatcagtgatggattcagtggctgaccacttacagaagagaaaggaatgttattctcatgcactgctgtaacatatggtcaccacctgaattctacttgcccagggtggagctataacatctactaggaagtttttagcaactactacaaagaccatagggtccctggggaaattgactttcctgctattcatgccttggtctagctgtccttgaggatgttataggttgacatgagccaagaagggtttgaaaacatttgagaaagcatgtctcaatggtctcaaataccttatgaaagtgtaaggtgacctctgaccttttcagcctacttcagctaagcaggtgactgagagaaaccctgcatcagatgggttaggctgcctgctgttgagtcacagtttgacttgaccatatgctagactaggaaagccagatgtgtggagacagtgcaccataacttaacttagaattgtgagtgacagagaggtagccccagccctagaattcctcagggtcaggaattttgtattcccacacattttggtttacattaagagactatctggtcagagagtggatagaggcctaaagcagcagcaacttgctgagtcccaggaattcaaacgtgacaccgtgaccaggaatgggagattataactattgccaactctcaataccactcaatcattgacagtcagctcagatcaaaagctgtttcaaaatgtagttaaaaagaaaaccactcagcaggaaagatggcaaaggaataaggcacctctattatcacagtctcaaattcaccagtactgaagtaaattgcagttcactgtattcttccataatgcccttaaatcttcatcataaccccgagcaagcctttgaaaaggaatccattgatgtcagtgtttgtgtaatgatttgtagaattggacaaggtcctaccaggtgagaagcactgttaattggtacacctctttgaaggtcaacaggccaaatcatttaacctttcacatgagcataccctttgtccagagactacctcttgaaagtgatcgcacagccaaactcccacaggaaagtagaaaggagaggacaaagaggatcgctgagatttcttttgcaaggatggcggtggggagggggcaaaacatccattgtccaagttcaactacagtaagttcagctatagtaggtagtctttttaagcctttggaaagattgaaatccattcgccaagtcctcaataggggagatgaccacacctctgatttagggaagaaaatgtgaaatgttgtaacgggaatcaaaccattctggttggctaatagcaaggaaatagaaatgaaagatgaagtctttctttctctcttaattacatatgttattaattcaagttgaacacataaacctattggttcagaaaagcaaataggcagaaaggaagttatctggaaagttccccagtcaagcaactaacagtgtgtaattttctacagtgatgtttctaatgacttgccttcacgttttaacttacacttgtccaaagccttgaaatgttgaaaatgagaaaagcttacatttgcaagttttttaaaaatcaagaaaccagcatcatctcaatatataattaggaaaacaacatattacaagatgtatttttctttaaaacatacacacttctacacacatgcaagatttaaaggctctattctgaaattctatttccaaattttacttaacagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatgtaagtaaaaagtcaccaaatcctgacaacctgtccacatgtgcccacacatgtacaattatataataaaaagagcagaatgcaatataacaaacatcaatggaatatctattaaacttcttaagagtatcatttctttactgctatatatttgttccacttactgatttttttccagatgcatataattcttacggtttgatcaacagtaaaagaatgctatgagatttaaccataaaaaactatcttgttcctcaagaaaagttaatgatattggagagtactcattttctagtgttgaattgagaattcagggcaccaaattctatgtgtagtgggaccaatgaggatggatttgaagaaaagaaatggaagtgtgtgtgtgtgtgtgtgtgtgtgtgtgtgtgtgtgtgtgtgcgcgcgcgcgcgcgcctagcattgtgctgaggaatgtggggagtatattaatgagatatagattaaatttatttcactgaataacatcagttcttattgaacagttatatatcatttttttaatgtttaaaccaatatactcatcaagctgctaatagtggatgcctcaaaaaagtgggatttgtgataaagtgtttccatttgttcttcatagattgtgtattctaagagatttttcaagaagctgataagatatttgtaatttgagagtcaacccagaacaaatatgtgcagaagaaattgttggtgaaaacttgatttgttggctatttgagacctaatatatttatatatttaactgatcacagaaaacaggtgtattcaagacacccacattttaaaaatccttatctgcttcagtgggcattacttgtggcctcactgcacttctttgtacaaggctaatgtgtctggttattttgtaaacaggtatgcttaattttaggaaatgcaaaaatatgagaagcaaccttaaaaatattgcatattccaaggagtagttaatgatgtttccaaagacctcaaactgtcctgagaaaagcatgtctgacatacaaggtaactgggattttaggttaaaaaatgtacattatatatggatagggaagataagagaatgtatggcaaagacattttaaaagttatttcttctagttttcattgagataccatttatttttggctttgtaatttcttaaaatatgagcagatttccaacagcagatgttacctttataattccttcgaagagaaacctccttgtacaatcaagtataaagaaatttccagctagggaaaatagatgttgatatatggaaacatgcaatttatgtaagttggtgcagaagactttgtataaaactatgcccagtataagtcaagttataattaaggtgaaataaatgtgcacatatatgtatagcaatattatatattatatatgccatatttaaactataataaatggagcaataagaaacatttttgtttgtttgtttgtttgttttttgagacgaagtctcgttctgtagcccaggctggagtgcagtggcgtgatctcagctcacggcaacttccggcctcctgggttcaagtggttcttctgcctcagcctccagagtagctgggattacaggcgcgcgccactgcaccgggctaattttttgtatttttagtagagacgggatttcaccatgttggccaggctggtcttgaactcccgacctcaggtaatcagcccgcctcggcctcccaaagtgctaggattacaggcgtgagccactgcgcccagccaagaaacatttttttgcagtgttttgattactaaacatgaagacaaaaattttatgtaatgtggccaaactgtctgagaatcaggagtggcaatctcctaggcaaaccatcatgtacaaacaaccaattttaatataaattcattgtcacatatgaacataaatataaaactctgtgtgtattgaaaggagtaagaggacatgatccaaaaagttatcagtggtcttaatcaattttatgacagcgctttactctttatcagtgcatggttatttctgaatccttggcaaacatcatgtcttaattactaatgaggaagtggttttaaggcttatctctaagagataaatggtaaatacagatataaagataaatacacacacacacacacacacacacacacacatgtccctacatatccaataaagtggtaggaagcaattggagaccacttaatggcatcggaaagtgtcttcaaatggtaaatgaaatcacaagacaaaactcttggaatgggagctacttgggcgcttctcttaagactccagccaaatggctgccaacaagtcaacacataagacttagatctctatcctgaaaatatagaattccttgggagccttacagatggatgagccaggcaaggacatgtggtttggtacttagagataacctcccggccttgagtttgtagcattttctttttctgcttaggcctggattcttgagtcttgaatccagaagcagacaacgtgataacttgggaaaatactggagatgtatgctgagtgagcgagaacacaactgtgaaagctaaacctattggaaatgcagttcttaaaaagagaaggcctcagtttcgtttcaaatggaaaccaaaagcaacagtgcagcagcgtgataagattgtcccaaactgggcaaaagtaaggctgccatgtttcctggcgcctttttcttgctggtgtttttttggacagaaagggcgggagaaggactagggagcggtacttgttggcatatctggagcacgactgccatcgtgaggaaatagttttaaaataccctacgccattacagcgtccgtcccgtgaggtctttcggtttagaaacgcccgttcagcggagagattgaacaggccctgacccgaaattgggcttccctgacttctctgaattattccgggagctctgggcaaagacttgatgctaatatgacaaaggtgatatccaagtgtaaaaacctgttgttggcgaggccggacagagccaacagctgccagaagtccgggcacaggaagttgtcgggtggggcttccgttgaggaaaactttcagggcccagtgcagggcttgtgcccattgtctcctg

SEQ ID NO: 980 - DNA, 3969 bp, mus musculus
gtattctcccagtatgggcgggactggaggaagccaccaaccaacgaagtactgggcctgtgggtattcgtctctctccccgcccctgagagtctgggaaaggctgacacgtggtgccttcaggctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcaggtacattgtaaagaagcatgattatttctagaaatgcaaaaacatgtggcaagattttaaaacctgtcattattctaaagaatacttaatgagatttgaagagcattcaagttacaaatgaggaaaacttgttttagcattcaaagtacaagagaatttgaacattttttaagtgtatattatttgtgcaaagtgaagatataagaatgtatggcaaggatatttttaagtggctatttcttgttgtgattgaagtaccgtttactttctacttataatttcttaaaatctaaacggtgccaacagtgggtgtaacttttgtaatttcttgaaatagaaaggtcttctagagtaagatacaaaaaaaatccaagcactcaaatatacattgtcattcatgtatgcaaatggtataaggtggtgttgaagaatttgtgcaaaactgtatccagtttgcattcaattgtctttaaagaaaaggatagtccatgctcccagaggctgaataaaaataaataaataaagagaagtaaatatatatataataggtgcaatcattttcttttccctctaggcctgtaaccaggtaacttggacctatctatctaatgcttatacatatatatgcattatgcatatcatgcataatcatggtcagtgttagagtgagtatgcgtttcaactttatagattttacataaaattttaagataaaattttggtataagttttgaaaaatataaacaaaagaaaccctaatgttctgaggcataagcacatagtgcctgttccaatgttagcatgtatatatatatatatatatagtcagcatactaatgattaggtaaggcaggtatcaaaattaagatacttgagtggtggcattataggtattatgtcctgtgtataaattttttaaaaattgagaacctaacattctttaatgaattagtcaatcaagaagctcattgcaaatattttattatctaaaatccaggtcttgcaaatatttcatgacaatttcagttacccaggaatgagcagtgaaaagtttgcatctaaaacatgatgcatatataaatttaatttaaatatgcttattgtagtgtattaccgtaaatatagacctctgtgcatgttgaaataatgggagtaaatatgcaaaaggctattagtgtttaatacaagattttatgacagtgcttttgttcttgatcagcacatggttattttctaaattctttacaagcaccatgtcttaattacttatgaggaaacaccataagactgattcctaagcttaagcagtggcacacacatatataataaagccataggaagccattaaaagtcaaataatgatgtgcatgggaacttgcttgtgttttaatgttgaatgatggaaccataagacaaaatcatgttcctttctactggaattttgtaagtttggagtgtgtgtgtcaccccaagagggatattgtatggaattcagccttgagatctatctggaccctcctattagggttctgacatggctgcccccaactcaatacacaagacctagtgcccaggtcagaaaatggaggactcccagggaacctggcagtgaaacaagtcacatggcctggtgcctagatttgttcttctctaggctgttatttccattattttcttcactttcttagccctaggtccctaagaatttcccactgaagcagataacttgggaaattgttggggatcaaggttgaatgaagaagagcagacctacaaagctatggtagagtggaaatgggcatttttttgtttttttaaattttattattattatactttaagttttagggtacatgtgcacaatgagcaggttagttacatatgtatacatgtgccatgctggtgtgctgcacccattaactcgtcatttagcattaggtatatctcctaatgctatcggaaatgggattctttaaacaaagtatggctgatgaaactgggtggtataggcttcagtctgagttcagagggaaaccaggagcaaaagtaaattcgaaagagcagattttccccaaacagggccaatagcaaggcagctttgtttcctgtctcctttgtcttggtagcttttttcagattgaatgggtgagaggagaagggctctgggggtggggtgcccaggcaaggctaatcagcttttccagagcaatactgccatcaagaggatgtagtttgacaaaacacaaacccaaagttgttagagcccccccaagttttagcaactgagaaatgttgggccttttgtgaggttgagtggaccctagccctaagtaggtccccttcactttaaatctgaagccttccaggagctctggacaaaggcaggatcctgggggagaagctgataagtggggggtcagggggaggactgaagggacagctactaggcaggtggagtataggaagtattggggcttagatatctacccagtgagggtggggctaaaacaaatggctcagatcctatttggggggacttctggccacatatcctctggccatgccctttgaacaatgaggtagggggttggcacaaggtgtaagcaatgttagggtgcagatgaaacatctcattccagatgatatctaacagcagccagcgtgctttctgggggtctcaaggatacctaaaagtctggtgcccccattgcctagagcaaggaagacctgaggagaaggcagtgtgtgtcacttggccaagccaataaatccttgaacatcaataggagtgcagatatacacaaccagaagacctggaagtattttctgaagccaggaggtaacagctaccatggctttgcagcactttttctagggcccagtgtgaaggcctacctatttagagaaacctactcttagctctattaaaggaacagaaatgagttctttagctattggccttcccctaaggaagatgaggccattgagacttgggacctaactgttcattcagattagcaagtattgttctctgtgcctgcttcttagcctttttctaatgaagattccttgtaagccctctaaaagctgagcacatcaggaccctcaggacacttgcccatagcatagcaagaaaaggcaaaaattttgtaagattgactgcatgtgagagttttctcgtgtatcagtgatggattcagtggctgaccacttacagaagagaaaggaatgttattctcatgcactgctgtaacatatggtcaccacctgaattctacttgcccagggtggagctataacatctactaggaagtttttagcaactactacaaagaccatagggtccctggggaaattgactttcctgctattcatgccttggtctagctgtccttgaggatgttataggttgacatgagccaagaagggtttgaaaacatttgagaaagcatgtctcaatggtctcaaataccttatgaaagtgtaaggtgacctctgaccttttcagccta

SEQ ID NO: 981 - DNA, 292 bp, mus musculus; identical to SEQ ID NO: 140

SEQ ID NO: 982 - DNA, 348 bp, mus musculus; identical to SEQ ID NO: 141

SEQ ID NO: 983 - DNA, 72053 bp, mus musculus
ccaccaataaggagcaaaggcccggggtgtggacggactttcctgttatagagaaggtgggagtagacagtatcctggtcaattgtttcagtcacaaccaatcaggatctttgagggtggagccatacactggcaataaaagaagcctgcccctgtggcggggcccattttgttttcgatcgttaagtgggcacgtggtggagcgttggtgtgtcaggggtgtcgacttcttccacaaactattgtaagatcaatttgcttttcatttgtaatagttattgagagttagatatttgtagtgtgctttctatatgtggctatatgaaatgtagtagtatactttttcttttcttttcgtttttctgtttttgttttttttgagacggagtctcattctgtcatccaggctgtagtgcagtggcatgatctcggcccattgcaacctccgcctcctgggtttaagcgattctcctgcctcatcctcctgagtaactgggattacaggcgcctgccacgacgcctggctagtttttgtatttttagtagagacagagattcaccatatttctcaggctgagctccaacacctgacctcaggtggtccacccgcctcagtgtcccacactgctgggattacaggcgtgagtcaccacgcctggcctctctttctgttactttggacctggaaagaatcagcttcccattgggagggattgtgcacggtattaggacagttaatggccattagctgctgcgatgttgtttgtatttctttcttttaaaaatgtaatatttgtggttatcttttggagtcggttctttcatccactcactttcaaataaaagaaaagttttctggtgtttaaaacttgaaaatgttgtctggtcagtgcaggaattgttcattgacaacttcagatagcctcctgttggtcattcgctattttgcatttttatacagtatagttgtgaatttaattgtattccacgaagagtgcttctcatatttttcattcatttgcctttaaaagtttggtcttaattgcagttgatgttttacaaacaatatggatgctctgcctctctagctgtggtggctagtgtttgtaatcccagtgctttgggaggtgggaaggaggcttgagtccaggagttagagaccagcctgaacagcagagggagacctcatttctacaaaaaaaaaaaaaaaaaaaaaaaaaaaaaaattaggccgggcgccgtggctcatgcctgtaatcccagcactttgggaggctgaagtgagtggatctcctgaggtcaggagttcgagactagcctggtcaacacggtgaaaccccgtctctactaaaaatatgaaaatcagccaggcgtggtgatatgtgcctgtaatcccatctactggggaggctgaggcaagagaatcacttgaaaccaggaggcgaaggttgcagtgagccgaaattgtgccactgcactctagcctgggcgacacagtgagactacatctcaaaataaataaatagccagatgtagtctccccgagtagtcttggccacgtatgaggacctctttagcccaggaggacgaggctgaagtgagctgcgtctgtgccactgtactgcagcctaggcgacagagcgagaccctgtctcttaaaaaaatattgttggcattggaaacttcataggtttcttatgaaaggttttgtacaagtttcagtttgcagtagaggaaattaactgtcgattgagtgcattttataacagaacagcctatttggtataattttatttgtccaaattctggtcttgtttcctcttcattaatttccttataaaataaaagttttggagtaatcttgatttacaaatgcacaatttaatcatctggctgtgtccttaatgttttgcaccagtgactgcacttaagtgtcttatcatcggctgccatttaatggaatttggaattttattttacagaggaattctgtgttaggtagcattttattccattaaatgtgggtcctagtccttttcataaattttgtgtgaagaaagttttgtattatcttcaatttacaaataacgaaaagaattttctaattgaaagaatgttttgtggcattttctttcttttcttttcttttctttctttctttcttttttttttttttttttgacaagagtcttgttctgtcgcccaggctggagcgcagtggcacgatcccagctcactgcaacgtctgcctcccaggttcaagtgattctgttgcctcagcctcccaagtagctgggattacaggtgcccgcccctatgcccagctaatttttctatttttagtagagacggggtttcaccaagttggccagactggtcttgaactccttacctcaggtgatccaccctcctcggctttccaaagtgctgggattacaggcgtgagccactgtgcccagcccgtttgtggtatttttaatgtaaaaatgcacacattgctaatttgcctgagagcttgttttaggacactaaattgtcacaagtgccaatcaccagccactgcagaaagttttttgggatatcatatcctgaaacaattgtgtgttgaggttcaatgtattcaattctgctcgagttttttgcatacgtttcctttaaaagacggaggtatttcagtgtgtaaatgaggaaattaactgtaacgtcaaatgtttactttctggcagtgaacagccgttggaagtcatgttgcctcatctgaattttattgtacagtatagttgtgtgtttaatataatggtatttatacattttggcataggtcctctttccaaggtgttccttcccagaaaaaaaaaaaaaaggtttctatttaagaataaggaggacagaagttgtctagggccaggttaggagagaaaatggaagtagatccttctagatccttctggatcttctgctcgcttcctggctggcatgcaccaaccctgtcccttagccacgcagtgtgccacagtgctacaagtaacacttaaaaggtagccgttttaaattggcagcactggcttctttacattcctactgccattttgtgactcctattgtgtattcagtgggataattaaaattaaaggaaaactttagtctctctcaaaaacttgagcataatcactgagaaacaagatttttgctttgaggataaagtgtaagtatttttttaaatggtgctgattgaatttacttattagtctttggcctggtttactcttttttttttttttttttttttttttgagacagggtctggctttgttacccaggatggagtgcagtggtgtgatcacggcactctacagcctcgacctcctgggctcaagtgatccttccacctcagcctcctgagtagctgggactgaaggcatatgccaacccacctggctaatttttgtattttttatagagacggaattttgccatgttgcccaggctgatctccaactcctgggtttaagtgatccaccccacttggccttccaaagtgctcagattatagacgtgagccactgcacctggcttatatttcttttttgacattatctgttaaataatgctatgagagttgaggatttttttttcttttttggacacagagtctcactctgtcgcctaggctagagtgcagtggtgccatcgtggttcactgcagccttgacttctgggctcaagcaatccttccacctcagcctcctgagtagctgagactataggcatgtgccaccatgcctggctaatttttcttcctcctcaatagactttaagctccatgggggcaagaacttttttcttccgtgctataaacgtggtgtctctaatagtgcctgatatatagcaggcactcaagtaatatttgttgaatgatttaatctagtaatttttctggatactgattaaaatgtttatttaattttactttttgtttttttgagagagagaggtttcactctgtcacccaggctggagtgcagtggcagtaatcttagctcactgcaacctctgccttcctgggctcaagtgatccccccacctcatcctcccaagtagctggtagctgggatgtgcacaccgcaatgcatggtttgttgtcattgttgttgttttgttttgtttttctttttgtttttgagagatggggttttgccatgttgcccaggctggtctccaactcctgggctcaagacattcacctgcctcaacctcccaagtgttgagattacaggcgtgagccactgtgcctggcctagcctggtttattcttgatttggatttgaattatatatattatctagcatctgaatgacttattagtacctttattggtagaaagttggtgttttccaaatatccttctagattgaatttagaaacctgaaaaatcagttgctggtaagaatgaaagttacctctgcctttgctaatataaggtgccaagatttcaggaattaagatattaactagcctcatagatcctgactttttgagcagagccctagatcttaaataataatttaaccctagaatttagaatttagatccaggtattaggccgaaggcacttttcttatgtccacttcgcccatagaatcctagaggggatattttccaaagagcatacccacaaaagccaatattagcaactgtaaacttttgtggattatttctttgaagatctattctcagtgtcagatggcaccaacattatttaatggttgcaattattcgtgaaattatcctaaatgatactagcttccttctgatgtccatgtttttctaacttactgtgttactaattacttacacgaatacaccatgagaatgctattgtataagctggtgaacaactcaaacctccgatttcaaaaatttgttatctgtgatcctgtatgagtctttttcaccatggtaatgaatacaatcaactgacatctttgagactcccctttctagaagttgagatcttgcctattagcttaatatataattcccctataatgtttgattaaagcaagatgaactatagtttattttgaagggacaatcaaacctctgaagcaatagtcttgtctgatcttgtaaccacaagattaatgcagttcctattatattatgtttcaccctgtatgattgggtaccttgatccaaccaaccattttcagaagtttctctgaataagtggaaaaggaagtgttccccagccatccaccaaaatgagttccaagttatgtaattttcctgcagtggtgctgggctgtccatccacaggcaagtctcttggcagattcatacagtcaccatctccttcagaacctgtgatggaaaagtccagtaccagtgagcctatggttctgtaatgtgaaaaagatggaattggaatcaattgtcaagatcacctagacaagttcagggtgtccttacattgtgtgaggtgactagtgtcttatgaagggcagccccctcctcctgtcccctgtgcatcattaatgatggcattgaaaccccttcctagagttctagagatagggactaccaacagtggtagtcactcttcctaagtactgctgactccatgatactgactctgtttctacaacctgttcctttcattagacaggggcatatttttctacttcttaattgtgttcctcatgtacactgtgggtgccgctgttacagagacattgacaaacttagactgttctgatttcaaataaacctgattttgactttttaacaccaaagttctgatctttatttctattttttggaaaaccagtaagagacagcagcaggagggactggactggattgtagaaaacttcaagagttaaggagtgcggagtgctgctcaggtgcctttgtttcaggtatgagaatatgggtctgaaggtaatttgaaagccagccttatatatacaaggagggaaaagataggtcctgaggaccaagtaggtgtcagggaatggtagtctgccagcctgctccacttgtgacatttatttgctagggttcctgaaggtatacgccagcaattaaagtaatatgtaggttattactccttcagatgtttactgttccatacattgttgtccatttccttgctctgcagacattgctggtatgacaaggttccagtttctgagtctgaaagacactgggctcattttcactctaaggcagtagtctggcagctcagctggtttctaacatagtattttcacactttgtgacactgttaaaaattgtcaatgaattcaggcattggaagctggggacaaagatttggggtttgcatgctaaggctccctaagccttgtgtttcctgtcttgttacacaaaagaagtacagtgggatgaatgaatttgggtaaatagatcatgacaaaaagtgctaatgttatttgggttatgttgaatgctcccatataataaatgctctctcttgtgcctgtccaggtcatagtctctgttctatatagcagccaaccacaagggttgattggtaagcattcctgcatctgtgctgttccccctagattgctatctgatatgtttgtttcaaacatgtggagatcctgtgtctgaacttgatttcaccattgctgtcaattttcaggcaaggtatacagtaactgggtcaaaattcctttctgatgaatgatagaatttcatatcaatttgggattcaagctttcagtacatgggaataccaaaccttagagtggggatcttctaaccaaagtttacacttctggagttgttgcctgctatggcatatgttctggaatgtggtctttccctgtagccatttaacagtaagccttatgatttgtacttattaataacatctgtagagtaaatgcctgaattatgtagttttcactcttggtgctttgtaaatttcctcttggattgcttttgagtcagacagacctcagtttaagcctgatttaccagtaactaactttctttcttttttttttcttgagacagagtctcactctgttacccaagctggagtgtagtgatgcaatcacagctcactgcagccttgacctcctgaactcaagtgatcctcccacctcagcctcctaactggggctacaggtatgtcactatgctcagctaattttttattttttgtagaactcctggctgttctcaaactccttggctcaagtgatcctccaacttcagccttctgagtaaatggggctacatatgtgtgtcaccacactcagctaattttttattttctgtagagtggggtctcactgtgttgcccaggctattctcaaactcctaggctcaagcagtcctcctacctcagcctcccaaagtgctgggattacaggcatgagccactgcatctggccatcagtaactttctatccttagttcccaactaactctttgggcctcagttttccttttctgcaaaacaggaatccttctttgctatcagaatgttgtaagaatcaagtgtcataatctttgtaatgcatctagtacacaataggcactcatgaatgagctctccatttcctgaatgcacatattggagggaggacatacagtgcttggtttagcacctctcccaccttcctttatttattttctttcctttctcaggtattgcacattcctcatagattatactgtcttctcttgggaaaccacaaccctgtaatctggctaaggatctcagattttttcttgctctgagctgagttctgttctgaccaactaggacacattacactgaggctagcatcatagttcagcatccagcaggactctagctatctgggatggaagatgcctattaactagcagtcctagaaatttctttcctcgcctgtaaaaagtcacatttgggttgtgattagttcactgaagattaggtgaagacacttgacaacgtaagaaatggaggattaaatgctaaatataaatatgcactatcctaagagtatcttttaacctttagtctcagtagatacctgtgattcctctacttttctgttagcacatattttattctggtagcatcatgtaatctgaagttcacccaaccaaggtaaaaaaaaaaaatcctcatttcttttttttagaaactaaagtgtctgttacatagcacattgacatttcaaagccttttgatttatccctgtaaatggctaaattactttaaaccatggaaggtggaaatcattgttgttatttcctgtccagtaaaaactggggccagagttatttagaaaaaaaaaaaaaaactctacctaaaaccacttaatggagctttgccaccaagttccttcatcaagtggtctgatagtgaccttagctcgtttgctagatgaaaaaaagagtgaatcctaactataactgtgacaccttctccttttgcacacacttgttctacccactgctcttcacagtcatcttgggtctcttctttggtagtttctctaagtattggcatttaaaaagtaagtcacaaggtagaggaatccaaaagggttaatctctgtttgggcagataagcccaagaggtagaaacctaggaaaggtgaaagtgaccctattcagaacttaaagtgggacctggcttcttgattcctaagaggtccagtcctttgccctttaactcaggggtttccaaactccgggccgtggactggtactgggcggtggcctgttaggaaccgggccacacagtgagaggtaagcagccgggcgagcaaacattaccacctgagctccacctcctgtcagctcagcagcggtattagattttcataggagcatgaaccctattgtaaactgcacatgcaagggatctaggttgcacactccttatgagaatctaatgtcttatgatcctgaggtggatccaattttatcccgaaaccatccctccacccccggtctgtggaaaatttgtcttccacaaaactgatccctggtaccaacaaggttggggactgctgctttaactcatctggggtctactctgtcaatggctactaattgaaagaaaaaattttgagacagggtctcactctgtcacccaggctggagtgcagtggcatgatcatggttcactgcagtcttgaactcctgggctcaagcagtcctcatgcctcagccccctgagtagctaggactagaggcactaccaccatgcccaactgattttttactttttttgttgaaatgggatgtccctatgttgcccaggcttgtctggaacttctggcctcaagcaatcctctcaccttagtctcacaaagttctgggattacaagtgtgagccaccatacctggccttgaaattttcacgttctataaattcttggtgtgacttcctctctccacactcatgttttcatgcttgtttatatgggtacaggagagagattaaattatagcagaaattttagggcaaggctatttgggtttatagatcttttatggagaaaaacatatttttcttaatacttcatgaaaacgtgctatacacacaaagattaatttgctcaaatttcattttctttaaaagtaacctcaaattataattttatgtgttcacaaggaaagtctagagactacaaaaagtggtatgctttttgtttaacaagtgactctccaaaagaagagaaaaaacctgatatgtggcatttgtcaatttctaaggtgtaaataattccaccatcaccaatttcaagtgttgtcacactgaatgcagattttggaagagatgtgcacttaccacctcatatgagccagctcttacacaacactgaataaattaaaaaattactggcaatcaaactgcatagaattatgaccactgctaacattttaatgttcttctaactaatctttctatgaaaaatatccatatttgttctagtgaggagtctttatattgaattttagtaagtacagtaagtcctcacttaatgtcttcaataagttccagtgaactgcaacttttgaagcaaaatgacttatgacaaaaccaaatttaccattggctgattgatataagcaagagttaggtctccatggcgtatatttctggtcatgaaaacatcaccaaacttctaaataaagactgaaaacacttttactattaaacactgaaataaaggtgagctatctatacctttaagaaaggttaacaaaaacaagatacaataattacccagctcttggtgaatcagtgagtcgtggtggtcattgtggtggtgggtttatttgtttttattattgttaccttttttttttttttttttttgaggcagagtctctctctgtcaccgacactgaagtgcagtggtgtgatctcggctcactgcaaactccgcctcccagattcaagcaattctcctgcctcagcctcccgagtagctaggattacaggctcctgccatgatgcctggctaatttttttgtatttttagtagagatggcgtttcaccatgttggtcaggctggtcttgaactcctgacctcaaatgatccgcccgccttggcctcccaaagtgctgggattacaggcgtgagccactgcgtccggccttattattattactttttaagagttggggtcttgctgtgtcacccgggctggagtgctgtgatgtaaacatggctcactgcagcctcaaactcctgggctcaagtgatcctcccacctcagcctccagagtagctgggactacaggtgtgtgccaccatgcctggctaattctttttaaaaaattgtggagacaaggtctcaccacgttgcccaggctggtctttaactcttggcatcaaacaaccctcccacctcagccttccaaagtgctagttttacaggcatgagccaccattcccagccgtgatggtggatttaaattaaggaagaaacatttgcaaagtgaaaattctaagaagtatctcctaccaccatgcagttcaaaaacaatcacaaatatggcaagctcactgagcactttagcacaacgtcatttattgttgtgcatttgtatgattatcatagactttctgaatttttattttacaatattttgtattcattcattgagtcattttctaacctacttactctgtttcaagcggtcacaggtggctggatcttatcccagcagctcagggtgcaaggctggaaccaaccctgggcaggacattacatcaccaggtgcactcacacacacacccacgctgactcacactgggaccatttaggcatgccagttaaccccatctacacatcttctggatgtgggaggaagtgagtacctggagaaaactcatgcagactccacccagacagtagccccagccgggaattgatttttttttttcctcatcaattttataaggaaacaatgttgtagaaaatgaccttatttgaggacctgcagtaaatctatgctttctcattcagatatctgactctagtccatgttactagactcaaatattatgcatacaattgggaaagacataaaaattcagtgaatttattttaaagattctagttttcgttgaatctaatgttctgaaaagcactgtacagtgtagcatttaacaagttgtatggttaatgcagatgtatcatctgtatgacttcagtagcagcatatataggagtggtgaaaagaccttgtaggatccttgtaggaacagttgcagttctgttcatttggcttgatgcagaccagttgtaggactgcccattgatgtaaacacaagtgagagaggctttctatgtcctgttcatatttctattcttagtgtgtggaattggtactaggaataagctgcctcctagtgaaggacctcaggtttaagtgaggcatctattattctaagtgaagtaactcaggaatggaaaaccaaacattgttctcatgcataagtgggagctaagctatgaggatgcaaaagcataagaatgacgcaatgggccaggcgcagtggctcatgcctataatcccaacactttgggaggctgaggtaggtgggtcacctgaggtcctgacctcaagttcaagaccagcctggccaacatggcaaaaccccgtctctgctaaaaatacaaaaattagccaggcgtggtggtagtcacctataatcccagctacttgggaggctgaggcacgagaatcacttggacctggggggcagaggttgcagtgagccaagattgtgccactgtattccagcctgggtgacagagtgagactccgtctcaaaagaaaaagactgatacaatggacttaggagactcaggaggaaagggtgggaagggggtgagggataaaagactacaaattgagtgcagtgtatactgcttaggagttgggtgcacccaaatctcacacatcaccactaaagaacttattcatgtaaccaaacaccacccgttccccaataacctatggaaataaaaaaattaaaaataaaggggacaaaagacacttacacatgtttgtgtgtagacacaatttaagaagttatgggccaggcacggtggctcatgcctgtaatcctagcactttgggaggctgaggcaggagaatcgcttgaacctgggaggcagaggttgccatgagccgagatcgcaccactgcaccccagcctgggcgacagggtgaggttccatctcaaaaaaaaaaaaaaaaaaagaagttctgccccaggccaggcccggtggcttacgcctgtaatcccagcactttgggcagccaaggcaggaggatagcttcagcacagcagtttgagaccagcctgggcaatgtggctagaccccatctctacaaaaaattttaaaaaattagctgggggtggtgtcacgcctgtagtcccagcagcttgggaggctgaggtgggaggatcacttgagcctgggaggttaaggctgcagtaagctgtgatcacaccactgccctccagcctgggtgacagagtgacactaaataaataaataaacaaacaaactaaataaataaataagaagttgtgctcaaggcctagaagaagctgatgagagtgctgtactgtggctggatcaggcagaatcttcaggccattggagtggagtactgcataagcactctggatagccacaagtacttcaggagagcctcatactgccagatttctcaaatagaagacctgtgagctttggcttgagctcttctcccagagtcaggatagaggctctgctctccttgcatgggtccttctggtgatatagtgattgatgacggggcaaggacttcagtagaagggacagggaaagatgggaactggaagcatggtgggaagagagcaagaagaagtatttatagtacacaaaggagtatgtataaactgctgcttagagcaacttcttttttcccctaattttgacctcttcccaacagattccctgtttctgctttaacctgggctgcttgctaagtgcttgcctctcaggatccttgtggaggtaaggatatatataagtcacagaggagaattattttaaaaatatgtattattttgactcacaaaacaaaatggatgcagatgaaggttttcacagcctatatgagtgttaattagaaccaattagaggccttgtccatcaaaggtgcttatttaattcaaatatgtacacaaagaaactgggccttatcaactaaatccatagctggcaccaagccatcaggaaacccacaacccaacaagtcctgtttccttggatttttgatcaaaacgaagtcaccctacacgcctggtcagtataagcataggtcatttgggtatttaaacccagtggatattttgattcctctattaagcagaaaacactgtccagctaccaattgtcagcctctctcatttttggccattacgtaaacctgtcctccatttgcacatgtatgttagcttggaaatatcaagagatcacagagggatgtttataaaattccatagaaaaatgctttaactatactgaagtttattgctattccagaggagttgataatgacttgtttcccatctgagtctgctcctcgcctcctcccctccccttgaacttttactggagtctaggaatcaattttatctaatttccaaatgtttcttgtccatggtttagctggattcattatatatatacccagagtagaaggtaacttggtgcatcttaatgacataaatattgcccttaccttgaaaagctttttctcccttcttgctaccttattttgtcattgttagtagaatcaagggctgtaatgattattttattaaaatgaggggttctctcatagtgcattgaccctactgtctcatttcattttacttatcacatgcaggcattttttgaaacttttatttttcatggtgttctaatgagtcagaagtgatcccaaaaatcttatctcttggtcactgagagtccagctctgggactgacatgcatttcctgcagtttctctgtgcagggctcttcagagtagaggttagccagctactcattgggtatacaaaccagttaggagctagaggtttgtgttttgttttaatttctatcaaacttctatgaaatgtgtggagtttagagactcaaatatctccaggaggtttactcacaaaaataatagttccttaacctaccatcattcctccatttcttaatcactttgtttatccagaagctacaacatgtggttgtgtgattgtagaaaaaactactgaaaaccgctcagaaaaatgtgagagcactaaaaggctttaagatgtggttctctgaccacttttgttgtctgtctgaggggagaagagttacaggggagaagtgttacagaggttggatccccagaaaacggggatcaggaaacatggaataacaaataaaaatggtttcttaccttcaaggacctacagtctagaggtagggagagggctgtgaacagcggctttttgtagagctgcttttgaggatgacaataaagcaaacaggaagacaaaggcctttgatgtgaaaggtgatgtgggccatgtatgttcaaggcactgtctcctgtctgcttctcccttcctacttctctctctgcttcaacatctccccaactggacaagcaacccaagggatatcacaggtctgggactttcgttatgtggcccaagatacagccagcaaatatggaagaacatgtatatatacatagctagagataaaactatggcattttgcagacactactcctccctctggctttcagctttagaatgtgggcattcaaaagaaatgtccagtactgttgccgctcagttttttttaaactttcatgtctcttcacaccctgtgccttgtagtttgcttcaactaataataatacctaaagatgatttttagttggacattagatgaatctttaaattttagtacccttgaaggcaatctcagtttgagatgtatcagttgctttaaatacttcacttaaatgtgtgttacatctgtggtccactttttaaacacttgggcaaaaagctggtagctccatgctcctaatgctatcatctttctgtctgttattaaagtgacatagccgggcatggtggctcatgcctgtaatcccagcactttgggaggctgaggcttgtggatcacctgaggtcaagagttcaacaccaacctgaccaacaaggtgaaaccccatctctactaaaaatacaaacttagccaggtgtggtggcgcatgcctgtaatcccagctacttgggaggctgaggctggaaaatctcttgaatccaggaggcggaggttgcagtgagtggagatcgtgccactgcactccagcctggagtgacagaaagactgagtgctctttatacatgagaaaaggatagtaagtagtgttaatcatcatctttttatcatctggagactgagaacaattttttttatcccagaaaagtatttttattcaccaaaatgcaggagatttgggctccactgcaggtgttttaactacgaatttattagtcgtagcttctcagcctgcaaaatgatagctcaaagtcttaggcatatgagcttcatgagttcacagaaaaccaggaggagacaggccaaattaggcaatataaaaggagtaaaggggaagtgtgtgtgagctgggaagtactttgggggcaatttgatcatcccatttgtaagggtatcaccgtctgagaacctttcccttcttataattagtttatatatttgattcatttctttctaaacacctttgcctcagtggaaaatgagtagttcggaattggattggattgcctctgttcagaacagcagggcatcaaagaattacagagaaataaaggtccttggtaaaatgctctaaataagtgtaaggaagaagcagataccaatgcccattttgagtatatgagagagtactaccttcttgcaaagttgggatattggtgatgggtgcagctcctttccattttcgctgtgaattctgcaattctgagctggtataggttttgctgctatagggtttgctggccctgccttttttgtggatttcttttgggcctgtgaaaaacggttctggggagaggtggcatcttaaactcctcacttaattggggagttgtgttacttagaacagacttctaagtaagtgatgttgttccaacataatccttgacagttttccttcagcttttccctattccatgtctttctgctgtgccttaatctgcagtggtggttgctgcctgtaatacttcagttccctcttgtaatccctcactgattttcaggagggcttagctgaatttaaaattttaattccttacatttgtcagtgtctttttctgatgttgggctagttctatgtaccaggtttcagtgccttctttcttctgattctcctggttttctggtctagatctttatttttttaaatatgatcttgtttgtgaggcctaactatagtgacacctctgaaatgatatgttttatgtctgttaaaagcatccattcttcaactaaatcctgctttcttttcatgaacttcatcagactatccacagtaaacaaaaccaagcctcgtttttgtctgtacttcttccatttggctcttctttatcatgtttttatctttgatgtgcctttcctctggacactaattccataaatttttctgccatgtggccttaggaaacatgtaactaatatatgtccacctacaataactgtcactagaaaatcatctagtaagtcttgttagtattttatactgatatttctgcactttccttctcattcatctatattttttatcttaattttcaagaagtgatttcctaattgccagtttcccaattaccgccacatttcttctgcagctccaccatgtgcttcttaataattttctctttcttggcttctgtaagaaatgggaattggagtcactccattccaatgtttaaattcttgcctcatttcaattgttagcttcttgggtactggtcatcctttgtcatctttaacaatttaaacatccttctgtatctaaatgcactcttgaagagaatggaggcctgggtttatgtcttttctatttttatctgtcccttctggtcttcaagatcttttattcccctgtatgtacaggtcgacttctaagatctcatacttggtattaagaagtctcttattctgttttcttctatttaaaaaaattcttccactgctcatgatctttgatttggcagattacttaactcctctgaactttcgtttccttaactataaaatggagctaagatctgttccagcttcttaaaggggctgttgtgagagtagaaggagttaggagtattgttaattctgggtcctcaaaaatgccaccggaataatctgttgctaaggcaaaattgagtttatcctgactgtggtgaggaggagcactaccttgacagagtcttaatagcatgatggaggggcatgcacagtctggatatttatgaggttttggagtgtgatttaaggtagctctttgaatgtagaagcttgatcaggattgggtaaggatcatgatagaatagttttgattggtggacacaactaggggaagcttttgagggaagagctttgattttaatcctatcatctgctgaatgtctgtttgctgttcatttgaatatttcttctggaagtttctgaaatgaacagttattttcaggttctttcttcctgtgcaagaatgacctggactagtaaagttatgttgatgggtacagtagaagtttctgaaatgaacagttatttgcatttgttccttcctgtgcaagagttacctggactagtaaagttatgttgatgggtatggtagaataataaaattatattactgaagacaaccaaagagtagaatcttgtccatgcagacagtgagctgtaaggaggtagatgcttttagttgtcagcatacagaagcactttgtactttatgaatggttgtggtagcattgataaggcaaatgattttgcttgttgtcgatttttatgcctttctacctaagtgcaattatgttttctgcttaaacttagtcgaaaagaaaatatttattcaggatgactaagcttctgaaatgtcatttaactaactttcttcaatacctgggctcagcctagcttgaaaaagtcaagtgtatattaacaacagcgattgtacatgattttcctctactccttcagaaagtgactaatcaagagagagaatggagggcaagttcagaggggttttcattaaggttaatccttaaaaacaaaataaaatatttgggggctgtgttagtctattttgggttgctacaaagggatacgtcagactgggtagtttataaagtaaagagacttatttgcactcagagttctgcaggcaaatagaggcatggcactagcatctgcttggcttctggtgaggcctcaggaagcttacaatcatagtggaaggcaaagggggagcaggcgtgtcacatggcaagagcaggagcaagcaagggaggaagtggctggctctttttttgttttgttttgtttgagacagagtctgactgccgttgcccaagatggagtgcagtgacatgatcacgactcactgcagcctcaacttcctgggctcaggtgattctcccacctcagcctcttgagttgctgagactacaggcacacaccaccatgcttggctaatttttttgtatttttagtagaggcgaggtttcatcatgttgtccagcctggtctagaactactggtctcaagtgatctgcccgccttggcctctcaaagtattggggttacaggcgtaagccaccgcacccagccaaggttattttaaacaactagatctcacatgaactcagagtgagaactcatttattactgcaaggaccaaaacattcatgagggatccgccccataatccaaacaccttccactaggcccacctccaacattatcggtcatatttcaacatgagatttggagggagcatacatccaaactatattggggcagatatactctaacatgctgagtgcaacactagaagcaaaactcatctggccaacctgaggcagctttttgccttctttgtagtatatctgaaaatgaaatcctggtgattctttcctgtctagcttccattctggtcctattgctggcttcactagttagctgcagctacaagctacatagtatagatttttaaaaaattcatcatgctgtatactggagaatgggttgctcagctcacagattagggtaggtaaaatataggaggattatatttaacattgggccagcagttaaaatttggttctcccaagataaatagttacaccaaagtcagatagctctaggctacacaaacatcaagtcaatattattgattagttctcttaacttaatagtcaggtgtgatttccttctaatggttctgacactgttgtagaaaataaatggacacaggggaaagtacattgtactttggcatatgttatggcttcttgataacctagagcttgtgtattcgtttgttaattttgaagagcttttgagactttgtagtgaagaaggaaattgctacaggaggctgtccccagtacttagtattggttactcttccaaatggatgtctgtattagctatatattgatttataagaaattacttcaaagcttagcttaaaataatacacatttattatttccaagtttctgtggatgtggaatatgtgagtgtggcttatctgaatggcttgtagcacagggtctcctaggaagctatgatccagttgtttgccagagctgtattatctgcagggagcaccttgaggaagatctgcttccaagatcactcatgtggctattggcaggcctcagatccttactggttgttggctggagacatcagttccttgccacctgggcttctccattggacagctcccaacatggcagctagtttctttcagagtgagtaatagcaagagaagtctgtcaaaatggaagccagtctttttgtaactcaatcttggaagcaacatcctgtcctttctactgtgttctctttgatagaaactagtcagtaagaccagtccaccctcaaggggaggagattgcacaagggtgtgaataccagaacataaggactgttgggggccatcttaaaggctgccttgcataatttttgacccagtcctatagttacttcaaaggcccagcaatcagcagtactctcttctgagtaccctgagtatcataagattgcataagattatgcaatcttatgaactcaaagagttagcctttatatgagtctgtcaccattgtggaagaggaaatttcatagcatcataaattcattctgtttcttgctagatgaaaggcatcacgtagtttaaagctccatagcatctagagcaccaagagaaaccctttgatggttttccctagagactgcatgtttgaaaatttcgtatgaaccaaataaactacattatagtgaatttggttcttaatcatatggaaatttttggtactggaagctatcagtttgggcttctgatgacctgttaatccatcaagttgataaattcctgcctttctacctatttgtacatatttatcctaaactctcagactttggtaatttaaataatactgtaaccctatttgcattgcctctgatttcacaaaggatttaatagactaatgcaactctaaaaagatgggataacgtgtgtaaaggtactcaaatagtctggatttcctattaagctagaataggattttctcttcttctaatttcccttcacctgtagctatagggctgtggataaaatagctgtatttaaaacacaacacctctgcatctcagctctgtttaatgttggtgaactgtctgacaacctgtctgacatatttttttttcttattttttacctcctcctataactctgggacttctttttgttccatttgcatgccaaatactttccgtctaagggcttttacttgtgctgttttctctgcctggaatgctgctcttagcgattcctgccctaatatcttaccatctcccattgcagtgtggtactagaccatcagagtacaaatctgtaccatcatgaaataggagaactggagagaacttcagagtaattttcctatctcatttggtagatacaaacattgaagaaaatagatttgctcaggaaataatgcatgacatacttgaaataactcaggacaaggccagacattgcagaaaatgtgaaaacacgtggcaaagaaagaaattttccctcagaacctcacagtctagttagagaggcaaaagtaacttaaattcactctatctgtattatgacttgaaggaaaggatacattgcagtttaggtcgagaaatcttagaaaatcttaatggtggggtgcaacttgttctagctttgcaaggatagagcgagagtaagaatcaacagaggggagggagagagtactggagaagaaaaaggtatgtggtaagggtataaaagtgggaggacacaataggaactgccgtctttaatgctgagttgctgattgcaatctgctgctgcaaccagacttacatctttcctaagcactaatgtcatttgaccctgagtacagaggctttattagattattacatctgtgacactatagctattagtcacactcagccataggacttgacaatctattggttttctatttttacttctgtcctggtaatatccctgaagtactgaaattatgaccagaaaattaatttctttgcatttgaatgagaaataaaagaacagcagaataattctacattcaggctataaatctctagagttgtcagaaacactgtgttaaaagtttggactaaattttgcattaagctttgctgctcctctccagaggaactgatgagagaaataccagatcatagcatgttaatgtagttcaaggctactaaacagatgcatgcacatacatgtacacatggttgtaatgttgattattttgcaagatcaggaaaggaatggctgtttgttgtgccacatacaattttctttcctgagtatgcaaatgagaccagctacttcttaatctaagcttctcagagttgtttttctgagggatctgcttatgtgtgtgcagtgtgtgtctgtatgtttgattcctcaacggagtattcaaagaactattccagtgcactctggaagtgaaaaaagcacagggtacatagaggttaagaagttacatacatgtaaagaaaggacatcacatctaatactgagaaatgaacacacaggaccatatatgttctctttcatattgaattcctgataagatgagctaggccacgttcaagggcttcccagaactcttccctaatacttagtccacagtctgatactggcaaagccagaagggctcttggggatcacttcccaatgtttcagtaaagaagtggcctttagtgggataaaggccacccagattgtgattgagctgagaccaaagtcttgcctcctgctatatgttgttggttccattccactgtgcaccttccctctctggagaactcaaaactcaaacttccaggaagttgatagttataaaggcagtacattatctctttttttcagatggaggaatggaactatagtgaaatgatttatctacagtcacaaggccagatatgggactaggtcaggaatctcggtgaccatgctctggccacacctctgtttaataactgcatcaatatttaggaagaaatgtcatgcaactaagtggtgaatgttattacttagactaactaatatgtattgcatgagacatttggtcattagaaaggctttgccatccttctggaattcaaagtcatacagggtttcttgaatgcttatttccagagctagactggggttagggttgaggtattaggggtagaaggggagagtggtgtgagcatgcatagttgaagttaataggggtttagctgtccagcagcttctaagcatataataaacgtgctttgtaagagtgaaattcataggtagaaagtagtaagcgctacctttgaggtctggacctggatctaaggctttatatcagcattcaagtgtttctataaggtataggcacaagggagtttcttaggcacttattttctgtgaagttggagaactcattgggcaaaataagaaataaatagaaccattagatgtccttggagaaaagtggtttttttttttttttttttttagtcccatgaaacagctttggacaaccgtcatctctagctccatgaactcagcaaataagcatggagttctattatattaatagagtagattgaggacatttaataactcattattttgcttatatattgaaatgagtaatgagagtgaagtacaaagccaatgttaactctgtgaatggagtactggttttctacttaataaaagctacaattagtatgaatgttgttgtacactgattgccaactgccttggagtgcatatcacccccgtttattgcaatttctttgacattattccatttgaattatttatcctagttttaaagggactctacgaaaaaatgcaataaatgcttataatactttttcagaaaactgtattccaaatcattttataaagcagtgtgaaaacagtaaaacagttatgaaccaagttggctgtctattgttctggctgattgtccaattcaggccagtctgtgttcacaggctgtcaagtgctatgaaagggtctcctcaagagggtaggaggtcagcccatgtgacctataaggtttcttccagctcttgagtatacaatttggtgaaaagctaaactggtggtagacaggatacaaaccatctgcaaatgtcatttaaagtgttttggattttttttcttagagcttataaggaccaaaattcttgccaaaaggcacagcttataccttcctgtttatgatagccattattcatttgttcacatgatttgaaataatagtgttatgttcaaatgcacagtgctatcactttaaaatgtagtaaatttttctttacatgccatttacagaatgctctgtcatacttaaccattgtgttattgaagggtgaaggcagtcaaggactttatagaggtcctatatatgtgaatgtatatatttgaaatggctgagtagagagttaaaggatacgtgatagcgtgcctgtttgtgggtaatacttttcctcatctggtgcattttcgtgtgccgtgcatgcgcatgcatacacacatgcacacagaacagggttatcatagcaggttataccatctgtaaggccaagagttctgtttgtagggctgcatttttatttgttctaaagtagtgattcttaacattttctttgatcacagatcaatttgttactctgttgacattgtatattatctacttggaaaaataggcctttgcacatagccatacacttttgtagttttctagagattcaaggattacattgggtgcccaatgtattacccagggtaggaattcctgttaatcttacctaagtagttatttctttattgggtaataagatatttgactgcctaccatgtactgtggcccctgtgctggatgtctttactaagcagccaggtgaccttggggccaaccctttaccttcccaggtttcctatgatgtaaaattagagcgttccaatggatgatccctaaagtcccttataatgttttatttactcagtcttattctaggcaatgaagggaatgcacagtccaagcatccaataaggtaggacagtgcccagaaccaggcaaacgaaataaacaaagagaaaaatgctctcactaggtaatctgaagaccaaacatttaggcaaaaaactgtgtcacattggtacaagtgtactgcagcaccaagcctgcttctatatatggcatttgatattagaataataattaattatgttgttaatccttttggactattgcatggttgttttactttattgttgggttgcttttaaagtttttttttttaattgaatctttttcaacctaatatttaatgagttgagttactgtttctggactgtaagaggtgggaggagatatatcctgtgtgaggaagctatgagtggtatttcacacaaatcctttcaaataaatcagatttaaagtgtttatgttattataggctgtactgaaaacatttcaaaagctcttagtaaacttgtccctaggctgcttatgtctgcatttattcagctttcagatgttcatttgctcatgttgggggtgtgtttgttttagtttttatccagtaccatttatttatgtattattattattattatttttgtgatggagtttcactcgtttcccagcctggagtgcagtggtgcaatctcagctcactgcaacatccgcctcctgggttcaagcaattctcctgccttaacctctccagtagctaggaccacaggggcgtgccaccatgcctggctaatttttgtatttttaatagagatggcgtttcaccatgttggccaggctggtcccgaactcctgatctcaggtgatcctcccgcctcagcctcccaaattgctgggattacaggagtgagccaccacacccggccaccatttaattttatagtcaaggtttgtataactgaggcttcaagctgtatcaggatgtccaaataggttcattaattctggaagattttctcctaacaagtagaaattcatcagcatggaatgatgacatcttaaacctattaaattgaaaatatctttatactcaccctggagcttaaatatgtcagccaataataattaaataccacccaaacactcacaattttctgagaagagaaaattagctggttttaatatgactggaagataaatcagaccatcaacattcaatcattcatatgagaaatttatataactcacattaaacacatcagatcaactggaaaattagagtaattaaatgttagaggggaatgaattttgttagaagagcaacaaagaattgacatgctgagagtgctgcaaagaccacatcctaaagactctcgagaaaatgcagacatacaagactggagggtatcatgaatgaacagattccctggagttcttaggagtaaacaggaggagtccaaggtgtccagattcttaataggtggatggctagacctggaatataacagcacactggagaagaggacagaaataccataaaggttgactttactccatttatctaaattaaaagccttttgaagttaaaaaaatataaatgtcttcaaatgtacagatgggtttctgataaagatcaacagccttctctccaatgtttctctatccccttctaccctcttcatatttgttttaaattcttctggctatttctctgtctccatatactagcttgaccattatttaaatttttatcttaggagatcctctatcgtcttttgctgtaatagttcatgtgccctaccctcatctttcctcttgtctcttctgccaaaatgtatgtcactactaagttctctgttcgttgcttctgcaacttcagccactgtacttcaacttccatctcttcttgggtcaagactccatgcttacaaggacatttattttgcaattctctccttcctttcacttctgtccctttcacattctgccctctgccctttacttttacatttcatggttgtcaagagcactctttcttttttatgaccctcttattttgttggagaaaatcattaagtaaactcctaggaaacgtgtgtgtgaggcagtttctgaattgttgactttttgaaaatatatttatttagacctcacatttgattgatagaattcgaagttcaaacccataagcctatggttattttctttcctctgttttcttttttctatctttgtggatcttttattactcagatattgtgtctcctggaccagtcctctgtaatatttatatttcttatatgtgtctctttgacatttcacctttattttctgggaatacattcccaagattgtgagactcatacttcactggacacctttttttaggctgcagtgcactccccaccacctccattccctgggtctttctgggtcccattcttctctcttaagcttctcattcataattgtgactccaaccatgatgttagtagacaaagaagtttttgtttctaatccttagatttgttctctaacaaataaaagatattcgttttcctttcctctctgtcgtcctccttaatttctcatgaaaatgcaccttctccttctcttggaatgccattatgcaatgtaaggcacaattaaagacttccttataattgtcaaaatatcacgtaattgcctttcacaatgccagacttgggctttgagtagaatttatcatgtgaactgtgctacaactgatttttataccattttctctgtaattggagtaaataaaagtagtataagggtcatacattattaaatgagccattaaaaaacatctcgaataacaaatggaagaagaggacatgttacttgcgtaggagtctccctatcagaaaattatgaatttttaaatctacagtaagcactctattgatatgagttaataattagctcattcttaattagcggaacacctccaaaataaccgccttgataatccaaattgtttttgcttattatatataaagaagtaatttaatttaagcactgcatctaactttacatcttgaaatatattgcattcctcttgttccacaagttctttagaattttcctgcaatgttgtgttttgtgctgattggaatctccagataatggactcatccagccacttacttgctgcaagattcctggcacacttagctctaagcatttctcttgctgggtaattgaccaaagccttctgcctacaggcaatgggtaaatgaaaaaatttcccaccattacttaaactgtcttgggatgctgaaagcaagattgagagaagggtgaggcttctgattttagagcttcgtcttagaatttagagctagaaagcaccgcttatttttcagagtgtaatactattttatattttattttttaacatttcttcttgatattttattttctctttccaacttttaggttcaggaggtatatgtgcaggtttgttacatgggtaaattgagtgttgtggaggttttgtgtacagattacttaatcatccaggtaattagcatagtaatcaataggtagttttttgatcctcaccctccttcctccctctaccctcaagtaggccctggtgtctattgttctcttctttgtgtccactggtattcaatatttaactcccacttaaaagtgaaaatatgcagtattggtttttctgttcccatgttaatttgcttaggataatagcttccagctccatccatattgctgcaagggacatcatttcattcttttttatggttacatagtattctatggtatatatgtactacattttctttatgcagcccaccattgataataacaagtgtttaggctgatcccatgtctttgctattgaggcactgcttctttaaggaactgttttctttatctatttttttaattcattgttaacataagctgctcttactttgtaaactttactttaagttctgggatacatgtgctgaatgtgcaggttcgtcacataggtatacatgtgccatggtggttagctctacctatcaacacatcatctaggttttaagccccacatgcattaggtatttgtcttaatgctctccctccctttcccctcactccctgagaggcccctgtgtctgatgttcttcttcctgtgtccatgtgttctcattgttcaactgccaattatgagtgagaacatgcggtgtttgttttctgttcctgtgttagtttgctgaggatgatggtttccagctttatccatgtccctgcaaaggacatgaactcattcttttttatggctgcatagtattccatggctatatgtgcaacattttctttattcattcggtcattgatgggcatttgggttggttccaagtctttgctgttggaaatagtgctgcaataaacatatgtatgtgtgtgtctttatagtagaatgatttataatcctttgggtctatacccagtaatgggattgccaggccaaatggtatttctggttctagatccatgaggaatcaccacactgtcttccacaatggttgaactaatttacactcccacctacagtgtaaaagagttcatatttctgcacatccttgccagcatctgttgtttacagactttttaaagattgccattctaattggtgtgagatggtatctcattatggttttgacttgcatttctctaatgaccagtgatgatgaactttttttcatatgtctgttggctgcataaatgtcttcttttgagaattgtctgttcatattcttcacctaatttttgatggggttgtttgcttttttcttgtaaatgtgtttaagttccttgtagattctggatattagccctttgtcagatggatagactgcaaaaattttttcccattctgtgggttgcctgttcactctgatgatagtttcttttgctgagcagaagttctttagtttaattagatcccatttgtcaattctggcttttgttgcagttgcttttggtgttttattcatgaagtctttgcccatccctatgtcctgggtggtattgcctaggttttcttctagagtttttatggtttttgagttttacatttaagtctttaattcatcttgagttaatttttgcataaggtggaaggaagggattcactttctgttttctgcatatcactagccagttttcccagcaccatttattaaatagggaatgctttccccattgcttgtttttgtcagatttctccagatcagatagttgtatatgtgtggagttatttctgaggcctctgttctgttctattggtctacgtatctgttttggtaccagtaccatgctgtttgggttactgtagccttgtagactagtttgaagccaggtagcatggtgcctccagctttgttctttttgcttaggattctcttggttatgtgggctgctttttggttccatatgaaatttacagtagttttttgtagttctgtgaagaaagtaaatggtagcttgatggaaatagcattgaatttataaattactttgggtggtatggccattttcatgattttgattcatctatccatgagtgtggaatttttttccatttatttgtgtcctctctgatttccttgaacagcggtttgtagttctccttgaagaggttcttcatgtcccttgtaagttgtattcctaggtgttttattatctttgtagcaattgtgaatgggagttcactcatgatttggctctctgcttgtctattattggtgttaggaatgcttgtgatttttgcacattcatttcgtatcctgagaatttgctgaagttgtttattagcttaaggagattttgggctgagacgatggggttttctagatatacaatcatgtcatctgcaaacagagacaatttgacttcctctcttcctatttgaataccctttatttctttctcttgcctgatggctctggccagaacttccaatactatgttgaatagaagtggtgagagagggcatccttgtcttgtgccagtttcaaagggaatgcttccagcttttgctcattcagtatgatattggctgtgggtttgtcataaatagctcttattattttgagatatgttgcatcaatacctactttattaagagtttttagcatgaaggggtattggattttatcgaaggccttttctgcatccattgagatattcatgtggtttttgtcattggttctgtttatgtgatggagtacatttattgttttgggtatattgaactagccttgcatcccagggtgaagctgatgtgatcatggtggataagctttttgattagctgctggattcagtttgccagtattgttgaggatttttgcattgatattcatcagggatattagcctgaaattttctttttttgttgtgtctctgccaggttttggtatcaggttgatgctggcctcataaaatgagttagggaggagtccctctttttctattgtttggaatggtttcagaaggaatggtaccagctcctctttgtatgtctggtagaattcggctgtgaatctgtctggtcctgggctttttttggttggtaggctattaattactgcctcaatttcagaacttgtttttggtctattcagggatttgacttcttcctggtttagtcttggggcgggtgtatgtgtccaggaattcatccatttcatctagactttctagtttatttgcatagaggtgtttatagtattctctgatggtagtttgtatttctgtggcatcagtgatgataccccctttatcgttttttattgtgtctatttgattcttctctcttttcttctttattagtctggctagtgttctatctattttgttaatctttccaaaaatgagctcctggattcactgattttttgaaaggttttatgtgtctctatctccttcagttctgctctgacattggttatttcctgtcttctgctagattttgtatttgcttgctcttgcttctctgggtcttttaattgtgatgttagggtgtcacttttagatctttcccactttctgctgtgggtatttagtgctataaatttctctcttaatactgcttagtagctgtgtcccagagattctggtacgttgtgtctttgttcttattggtttcaaagaactttgatatttctgccttcatttcattatctacctagtagtcattcaggagcagattgttcagtttccatgtagttgtgtggttttgagtgagtttcttaatcctgagttctaatttgattgcactgtggtctgagaagctgttatgatttctgttcttttgcatttgttgtggagtgttttacttccaattatgtggtcgattttagaataagtgtgatgtggtgctgagaagaatgtatattctgttgatttggggtggagagttctgtagatgtctattaagtctgcttggtccagagttgacttcaagtcctgaatatccgtgttaattttctgtcttgttgagctgtctaatattgacagtggggtgttaaagtctcccactattattgtgtgggattataagtgtctttgtaggtctctaagaacttgttttatgaatctgggtgctcctgtattgggtgcatgtatatttaggatagttagctcttcttgtttcatcaatccctttaccattatgtaattcccttctttgtcttttttgatctttgttggttcaaagtctgttttatcagagactaggatggcaacccctgctttttttgctttccatttgcttggtaaatattcctccatccctttattttgaacctatgtgtgcctttgcacataagataggtcttctgattacagcataccaatgggtctttattctttatccagtttgccagtctgtgtcttttaattggggcattttgtccatttacatttaaggttgatatttttgtgtgtgaatttgatcttgtcatcatgctgctagctggttattttgcacattagttgatggagttttttcatagtgtcattggtctttatattttggtgtgtttttgcagtgtctggtaccggtttttcctttccatgtttagtgcttccttcaggagctcttgtaaggcaggcctgttggtgacaaaatccctcagcatttgcttgcctgtaagggtttttatttctccctcactggtgaaccttagtttgtctggatatgaaattctgggttgaaaattcttttatttaagtatgttgaatattggccctcactctcttctgggttgtaggttttttgcagagagatccactgttagtgtgatgggcttccctttgtaggtaacctgacttttttccctggctgaccttaacattttttccttcatttcaaccttggagaatatgatgattatgtgtcttggggttgctcttcttgaggaatatcttagtggtgttctctgtatttcctgaatttgaacgttggcctgtcttgctaggttggggaagttttccgtgataatatcctgaagtgtgttttccaacttggttccattctccccatcactttcaggtaccccaatcaatcgtaggtttggtcttttcacatagtcccatatttcttggaggctttgttcattccctttcatccttttttctctaatcctgtcctcacaccttatttcagtaagtcgatcatcaatctctgatatcctttcttccacttgatcgattcggctgttgatacttgtgtatgcttcacaaagttcctgtgctgtgtttttcagctccatcaggtcatttttgttcttctctaaactgattattctagctagcagttcctgtaacttttttcagtgttctttgcttccttgcattgggttagaacacactcctttagctcagaggagtttgttattacccgccctctgaagcctacttctgtcaattcatcaaactctttctctatccagttttgtgcccttgctggagaagagttgtgatcatgtggagatgaggcattctggtttttggaattatcaataatttgtgctgttttttcctcatctttgtggatttactttggaaggggttttgtggcgggggggtcctttttgttgatgtggatgttattgctttctctttgttagtttttcctctaacaggcccctcttctgcaggtgtgctgcaatttgttggaggtccactccagaccctacttgcctgggtattaccagcgggggctacagaatagcaaagattgctgcctgctccttcctctggaagcttcatcccagaagggtgccggcctgttgccagccagacctctcctgtatgaggtgtctgttaacccctcttaggaagtctctcccagtcaggaggcacaggggtcagggacctacttgaggagacagtctgttccttagcagagctcaagtgctatgctgagagaaccctccttgtcaggatccactgctctcttcagagctggcaggcagagatgtttaagtcagctgaagctgtgcccacagctgccccttcccccaggtgctctgtccctgggagatgggagttttatctataagccgctgactggggctgctgccattctttcacagatgccctgcccagtgaagaggaatctagagaggcagtcttaccacagccactttaccatgctgtgttgagttccacccagtccttaccactgaagggaaaaccacctactcaagcctcattaatggtggaagcccctccccacgccaagctcgattgtctcaggtcgacttcagactgctgtgctggctgtgagaatttcaagccagtggttcttagcttactgggcttcatgggagtgggacctgctgagtggggagggaacttttcaggggaatgaatggttctgtctcgctcaggttccaggcaccactggtgagggggaacctcctgcagctagctcagtgtctgccctaacagtcgcccggttttttgcttgaaacccaggggcctggtggtataagcacagagggaatctcctgatctctggattgcagaaaccctgggaaaagtgtagtgtctaggctggatagcaaagtccctcatggcttcctttggttgggaaagggaggccccccagctccttgcacttcctgggtgaggtgatgtcccaccctgcttctgctcgccctctgtaggctgcacccactgcctaaccagtcccagtgagattaacagggtacctcagttggaaatgcagaaatcacccgccttctgcgttggtcttgctgggagctgccgactggagctgttcctattcggccatctttcccccataagctgctcttattagggcaaacatttcacatgccattcctcactttacaatcattacaatacagattgtaattttgaaagtgacagatgggggcgtgtcagcatgtcttccatacttaaaagtgattgagagaaataagaccctcagcacacattgctattcattctgcctcattggagctttcatgaaagactctcaaatgaccatgcttttgcatatctggatttaagaagaagagaaggtgttccagagtacagtatcttaggacttgagaaatcattaacttcaaccaaccaaccaattaataaattcctgttatagtctttcttttttttaacatgtgtcaaggtaatgagcaaacttttttgttattaatatttagaaaaaccaccataaatacaattgttctttggtatctctgggggattggttccaggaatccccacagataccaaaatccttggatgcttgaatcccatatgtaaaatggcataatatttgcatataatctacctatgtcctcctgtgtactttaaataatctctagattacttagaatacctaatataatacagtgactacatatcaattcattcctgaagattcaaagttttgctttttgaaactttttgggattttttttctgaatatttttgatccttagttgaatccacagatacagaacccatggaatacagaggaccaactatttagctttagtgtattctgaaactgagtcttaaactattctgataatattaagataaacttagcttttacagagtttggaaagggtttgcctttaagattgccccagtatatttgttagtgaattttttacatgaattaatgcaactttaaaaaatattaatttttttctcttatgttttctttaattatctttattttaaatagatattttagaatagtaaattatctttcacagcagtgcctcctggactgataatatagtacccaatttctaaatgtaaagattttaaagtgcagttataatgttctatataagcatttgaaacaactgtaagaagaaggatttttcttttttgctatccaggaagaaaaagtaaattattagatcattagcattagaaaaataacatttaagtaaaatatttatactgtggtgaataatggtttctttttatttttgtctaatttcaaggcaagatctagtgtcagattttagtactttcagcattaacctactgaacagaatgcatttcaacagagcagaaccatagggtattaggaattattaggactcctgtatgtcacactgtctcctgctacagcagaagagggcttcaggctcttagagaagtgcttacataaaaataaaaactattctcatacactaaatcttcatttcactgcagtattgaataccagtttgattaatgcctatttctgccatttagcatcttggacttgggaaattttgggttgcagggaaggatttggcaatggcctgttgtcagtcttctgtgctcttatactaatctgctgaacaggctgcatttcaacagagcagaaccatagggtattagcaattattagcactcttatacctccaaattattagcattttcttgtatcgtaagtctgagatcattcattcctttgtaacaatctgttggagatcattgtcagtgattttaaggaagaggaagagtggaaggtaagcaagcttctgttaaacagaagtccttatctaggtcctgaacccgtttatggagtagtctggatctttgagggtttgaagtcactcagaaaagtggcctggctagccaagaactttagggggagagaagtcctaagaattaatttaatagactgttttgtacctagagcgatcctgtgatcccagggagcctccaaatctaggatgcttggattctttttgacattgtcaactttgtcaccagattttggttctgtgaagtaatggcaccaacaacaataacaattagcatttgttgagtgcttaatatgtgccagccaaagtgcaaatacgttaaattcttacagctacctggtaaggtaaagtctagttctcagtgtataaatgtgagataagatgctgagccttaaagaggttgggttattgttcatccagtgaggcttttggatttaaaccacaggcattggaacaatagagcagttgctcttaactgctatgtgtgttatcatgcctcctgttacaataaaatgattgagagagactcaacttgtattaggagctcctgaagttttttgtcttactttggtaaaagtattattaatatgctaggagaggggatgaaaggagatcgtatgaaatgctcagttaaaaccagagatggcagaaatggaggggaagagaaaagagactgggcacagtggctcacactgtaatctcagcattttgggaggccgaggcaggtggatcacttgaggtcaggagttcgagaccagcctggccaacattgcaaaaccctgtctctactaaaaatataaaaattacccaggtatggtggcagacgcctgtaatcccagctactagggaggctgaggtgggaggattgcttgagcccaggaggcagaaattgcagtgaaacaagctgagatcacgccactgcactctagcctgggcaacagagtgagactctatctcaaaaagaaaaaagaaagataaagaacaataaatagaaaatggttaccaacatagtagttattaatccatctatgtcaataatcactttgaatgtgaattgtatgaatatgtagattaaaaaagactgccaaagtagatgaaaaactaaggccccaaatatatgtcgtctaaagatttaagtacttcataaggaaagagatggaggaagataaatcaaaagaaacatggagttaactatatcattttcagacagagcaaacttcagaacatggaattttttcagggataaaagtaggcattgcataatgataaaaggggtcaattcaccagtaagacataacaatccttaatctgtgtgtatctaacaatagtttgttgaaatgtgtaagacaaaagctgatagaactgcaagaagaatagacctccactatttatacttggaggttttaacacacctctttaattaatagatcaagcaggcagaaaatcagtaatgtgtggttgacttgaacagcaccataaatcaacttgatctaattgacatttatagattactttgacaacagtagcatacatattctcaagctcacatggaacattcatcattatagaacaggttctggtccatatgaaacacctaaacaaatttaaaagaatatatatcatgcctgtaatcccagcactttgggaggccaagacaggtggatcaagaggtcaggagatcgagaccatcctggctaacatggtgaaaccccgtctctactgaaaaaaaatacaaaaaattagccaggcatggtggcgggcacctgtagtcccagctacttgggaggctgaagcaggagaacagcgtgaacccgggaggcggagcttgcagtgagccaagatcgcaccactgcactccaacctgggtgacagagtgagactctgtctcaaaaaaaaaaaaaaaaaaaaaaaaaaaaatatatatatatatatatatataatgtaaagtatattctcagaccccaatgaaattaaaattaaaataacaaagatgattgtaaactcccaaaacatttggtgattaaacagcacatttttaagtaacagctgggtcaacaacagagtgtacagataaattagaaagtattttaaactaagcaaaagtgaaaatacaacttaccaaaatctgtagggatgtagcaaaagcaatgcttagaggaaaatttatagcgttaaatacgtatactagaaaagaagaaagatctcaaatcaattagtttagcttatactttaggaaactagagaaagaagaacaatttaatcctaaggcaaacataagtaaaagagacaatatgaattaaaggggaaatcactgaaattaaaaataggaaaacaatagagaatgagaaaatcaacaaaaccaaaatctggttctttggaaagctctgtaaaatcgacaaacttctagcaaggctaacaaataaaacaaagccacaaattactaataccagaaatgaaagagagaggtcatcactactgatcctgtggtatattagttttagttttagaaaatctaaaactttctaaaataataaagtctgtttaaaatattaaaactttttatacctaatgcatgcagggcttaaaacctagatgaaggactgataggtgcagcaaaccactatggcacatgtatacctatgtaacaaagctgcacattctgcacatgtatcccagaacttaaagtaaaataaaaaaaaaaattaaacatttttaaatgaatagtgattgatcaggagtttgctgaagcataggggtctctatgtagatgatagagtgcatgcaaaggctgactcataaaagatcttgtttagtttatgtatcagtgtctagcatgctatggctgcaagggatagtagaataaagactccagagagcctgggttacttagccagacctgtgaatgcatttgggggccatgtttaattggcactcaccagtcttagaagctctgttgaattaatatgtttcacaagaatttaagcgaaatttttcaaggtgaagactgacttgccttttattttcccttaagaggaaatgggccgttggtagtaaaaggaagaaagattgaatatagtgacaacagccataatagcagctgataatgaacagtgcctatcatttgtttttttcaactgccttatgccaaggttctttgagcaaataacttttgaatgacttttaaaatttacattaaggatgactcacctgaggtataccttatgattgtatgtaatttcaaatgctgaattcctgtcccaaatctctgcctgtgagtcacagggctgctagtctagcttctaacaaagagaaatcccctaattggctcttcctaggaatctctagctttgggttttcagaaaataaaatcatatgggtcacaaaggactgacggtggggaatgtcaaggggtccacagataggaagaaggaaaaggcccaaaccaattgtcatcacaccttccctattagcagccagggattgtgagagagaagagttagaaaatgggagggctcagatatttggggaggaggatccagacatccacagtttgatgtacctgaactaatattgccaagatttatttggctctttgaaaaatttgctattaaacactactgtgcacttacttatgttctacatgggcagtgtgtttaatagatcactgcaggaccctgattataccccttttgcttattatattctgtggattatttccacgtagagaaaacaagtctcactggaacaaaataatcatactcactcccaacccaaaagggcattacctctgttacagactgaattgtattttcctgcaaaatttatattttgaagctctaacccccaatacgactgtatttggagataaagcttttaggaggtaattaaagttaaatgaagtcataaaggtaggcttctaatctgatagaattggtggccttacaaggagagatctctttctcttcccatacgtacatacacaccaagaaaaggccacaagaagacaaatgaccacatctgcaagtcaggaagagaggcctcaccagaaacaaaaccttgctggactttttcttggactttgcagcctccagaactgtgtgaacatacgtttctgttgtttaggcaacccagtctttggtatctgttatggcaacctgagctgactatgacatcttccatctttttctctagccctggaggatcattagaggcaatagctactgagtattgcctacatgtaaaggacaaataaattccctcagtggaagcttggtgtttacatgtttaaagggcagtttggcttgtctctttgtctctttgtgttttaatagcagaatggcatttcacgtaataatttaactccatggctgactctaatctgggtctgccaatgggggtttgcattccttgcttgtgatttccatcacctgacacctaatgtaatgatttccactgcaagggccatctctgtgtctatgaagctctaatctcattggcaaccttgtgatagctgggatatcctattcaatcaggaaactagtgctgtgtataattaactacatcccttccccaaccccagcaactgttatacatcacttcccctaaaactaagtgaaagaaatatttttcccacttccttttcagtaagtgcagacagccactttaagctttttttgtcattcaaagtattcatcatgagcatgtatctgttgaaaatttcagatgcattcttttaaggatgtcattagtacctgagctccctcactagctactgtacttcaggtcagtcattgtaactggagttccagccatctgcatttaagcagcagccatctctgtgattgtcctctaggactacaatagatctttaagctgataaatagtacatgtaattttactgtcaacactgcagttcattggcagtacctaagaaccagttattctgtaagttaggctgattcaatagccttatggggtaataggatatgggactgggatcttgagggcagggtttgctatgattatttaggttgtatcgttaggcattattacaccaaataatttatccaagtggatggtcttcaattttcaagtcactcagattttgagtgactgataaattaagagaatgaggttcattttggggagtgagaagaaaaaaagtacatcagaagcttggaaagggccagaatcttaaaaccagctaagcccataatgcattccagcgaattgttaagatgctattattatgttaagaagtcctctgctttcctataaaggtctctgagagtattttctgttggccattaagcagagctaggcaaaccagacagcaaatgtgacttgaatgctcagtgctgtaaaactattatgtgaatccatttcagtttaggtatggaagatgatggtgcctcagtgctgtttgcatcattaaaactcaggagggaaaatgtaaagtgagtggaaaagaggaaggtaaaataattaattggagctgtaagaccaatgacactcccacccggtcaaaccccatctatagttaaagaattaaatgctgtctagaggactctgaatgagtcacttcttgagaatctctgaaaggctgttaaccttttgcccgtatgtaggaagcataacccctagaacatattctgactgtaaggactagaaaatagaaatcaggattaggcagacattcttagagcttatccaggagagtttagttactgaaacaacaaatatcctcattacccaaactctcctctctagcccagcacaactccttgtactttctgacttttctgttgcttcccatctctggaatgtgccctcccagcctttcacttaatgagtaaaaaggcttagcccaatgctaaggtagactggaaaaaggagactgtacttaagtaggtactttttctagtcttggttcaaacacttaaaacctctctgacctgaatttacctatctgacaaacttggttgtgaaactagggatctcttatatcccatcatcaccaagaattcttaaatccctacatttaccaacctaagagatctccctgctttgtggcccgttgccgtgcaggatttacttacgtctagaaaagaacattaacttggctcctgagttttcacattaaaaaattaatcctatactctttgcttgtctcaggtatgaatctgttttataccagcagggaatattagccctctatactttttttttccttttttttttttttttaaaaaagagtctcactctgttgcccagactggagtgcagtggtacaatctcagctcactgcaacttctgtctctcaggttcaagtgattctcctgcctcagcctcctgagtagctgggattacaggcatgcaccaccgtgcctggataatttttgtattttcaatagagacagggtttcaccgtgttgcccagactggtctcaaacttctgacctcaagtaatccacccgccttggcctcccaaagtgctgggattataggtgtgagcaaccacgccagccctctgtactttttctattcatattttaagaagacatgagctcatattatactcatggttaatatcctgctttcttaacattatacttatgtcatgggcttcttagaataaccgtatattctgaaatgagtactgtagacatggtatatgagtggggtcacttttgattgaaggtgtcagaaaaacaattcgaagtggcttttaagtaagggaatttatggcatgttactgggaaattatttggtgacacttagtttcacatatagtattttctttctttttcccagccctgctttctctggttctctgagtcttggctctttcctcacacaggaagatgccttttccatgtggcaataggagacagctaccagtcctctcacccccctccccatctacattataaggagagaccttcaaactggaagggagatctcattttccccacatggcttggatgccctgttgtcccatgatgggcaggcagcgctctgattgtctgctgactaacaaaatcaacagcagtctactatattctattcctactctgctcagcaatcttcagactctccctgaaatgcacatggcagtcccactgcttttcctgggactttttgttaaacaacttcctggctggaatcacaaacacactcattctctttccaactgaaaataaccaaaagacaatcaagttgatgttttcagtgatatctgtggaggaacttctttccagaattgtggaatcagttatgtgaatagactttaataggaataaaaatccaattttacttttttttccaccttttcggtagtcacaaacacattcactccctttcccgcattttaaagtgtttcttcaaatggttttaaagccctgtaaacattgagacccacttaaatgccatttgtgatctgaatgtcaagtccccatttccacccaagtggtgctgcctgaactctctaagtgtgtaactgattgtctactgtaatctctcttgaattcagactccactatcgtaagtcaatttttcaccttttatctctggggccacatcttggactcagtaaattccacattctcgtgactttggactacatccataaggatattaactgctattgcaccattcttcatgcttttctactgccttttactgatattgatcactcttttctacagtttgatctctattgtttgtcagtgcatcattatctgtcaaaatcccatctacgtcatactataagcaaaccttgaatgtaaaatagagacttaaacagaacatcagttaggaagccattcactgcaaggaactctagcgacttaagtaggagtttaattattttaattgtttcacataacaactgtatcttgggcggtcaaaatttctatttaaggcttcttccctatatgaatatggaattaatgattaaaactaagtacagaatcatttaggcatgtttgactttgaagtaacaaaaatttttactgcatgtaaccccaactacaggctcttaatcaaataagagtttgtttaactgtcatatcacagaaaatgtgatggtagtaaattcagtccttgtgtagtagctagctccacatcattaaggatcaatgctcttgtgatctttcattttaccttgccatcctgcacttgctagctttccaattcaactaatctaaaatgacttttcttctcaacttttagtcttaaacctcatggtattccatatccggtggtcctgggctttcaactgcaagtaacaaaacacagctacaatagcttaaataagtagggtggttattgcagtggctcaatggcatcttcaaggaacaatgttcttaaatctttttacttttcaattctggttgtatttcatcttcatatttcttgtctcatgagcctaggaaggcttccttactccagtcatcttctttatacttgtctcatggtgctttatttccttattccagctgtcatatatgtattcagccagtgaaaagggaaaaagtgaatgtcaaatggcaaaatgggtccttctaaacgtgtctgtctttatcaggccaacaaactcagtagacttctgctgttggttgacagctgtgtcatatgtcctccatatcctagaaaggggattggaaagggaaatgctgtgcatgggggtttgggtcagcaaacctctagtacctgccaaacggaattagatatcacaatagattttccagaactgtcaaggtattaagctatgcctagagtcaccttattttatagatcttagatctgtactgtcaaatatgatagctactagctacttgcaactatttaaattaaaaattaaataaaattcaggttcctactctcattagtcatattcaagcattcagtaaccacatatggcttgtggctaccatattaacagtgtggatatagtacttttctgtcactgtgaagtgttctgttgcacagtgctgtagtagataaaatagggtcagtgaaggaacatagttaatttacagttctcagagcttgctagcagcagagcagacactaagcacgtggtcttctgatgtttgatcaacattcttttaagtagataacatggcttcttaaacatttctgtcctcctgcttaatattattgcttctttttttaaaaaaaaattatacctttatagtttattctatcctctagtgaatatgattagctaaaagtatatgagcaatttgtggtgttttcactcattaaactgcttaacattacaatataatgaggacctgagtggtcacaaataggtcatttgagactagttaaaaattgtggtgatgatgaagcaatctgttttagccttaattctatgttttcatttttatggtggttaaaatgcattgcctctttaagaaaccagatggtaaaattgagtgttttaaaagacagaaggtggaatagctggaggctcaaagtgttgctcacccttcagaaagctttttagatcctcagcatagagaagggctagagtgggagaagtgcagaagcaaagttgtatgtaagagtaataaaaagcagaaaggccgttatcacctagattctatgcaatatcaagctataaatggaaacacctggtttaaagtgtgcaaataaccttgggtgatggtgagggggacaaaagacgttagttagaataaaaggaatattagaagtcagagataagagtgctctatgtatttgaattccttctttctttggtcatttatttaagtgggctattttacaaatagtaaatgggaaatgttaaactgctttcttatttatctaaaagtatatgcacacataatctggtttattgctggtattcttgatttcttaacaaaaatttatctggtttgcctgtgctgcctgaagtagacatcattaatcaccttgtggctatagctagaggtgaaagtatttcagaggagtaaacatcatcctctcatacctggccttcatttctaactccctttgtataaggaataaaaccttagcaatgaaaaccaaatacttagcgaccacccactctagtgcattagttagaacatgtccaatattcttgagcattggtctcatttttttcatacaaagaaatttaacctttcacctaactcatttccctggtccattcagtctctgtgtatgtgtctgtgcatgtttttcaagcactcagcaaggaagtaaataactaggataagcatctataggttgagaagatcttggtttcttctagagatgtgctttgttttcacatatccagaagacacaaatggaaattgtgttttttaggaaaatacagcacaggtaatcagtggagaatctgatctgagttcagtccctagctatgaggatgtgtatttgacagtctatgtactgatattgaaagaatatgagggaattagctttgtgcccttgaacaagtaatttacccataggcttatttttctcatttgtaaatgaggagcatgaacaagttttttttgtgacccaagtttcatgattcagtgggaaatatccctggcttagtatttagaagtcattaaatgtgtaacccctccacacacatgaaaaagtacactagaaattgctgaaaacaaccgcagtagaaaatgcccagtacaactcattgtctctttcagtgagaaaattgcaagttccaaaggaaattctcatgaattctgactctcatcaggaggcactgagtaaatcaatgtattattgatcaacctgctctcatgaatcttttctctccatttgtctctttacctatatggtgagtgacatgtccagcagctcctcagagaagtaagcataggtggctcaccaaattccaagggagttgtgcttagtggagcaaaaacaagtggactttaaagaatgcaactgggccaggcgcagtggctcacgcctgtaatccaagcactttgggaggccaaggcgggcagatcatgaggtcaggagatcgagaccatcctggctaacacggtgaaaccccgtctttactaaaaatacaaaaaattagccgggcgtggtggcgggcgcctgtagtcccagctactccggaggctgaggcagaagaatggagtgaacccgggaggcggagcttgcagtgagccgagattgtgccactgcactccagcctgggcgacagagccagactctgtctcaaaaaaaaaaaaaaaatgcaactgttccactatgttgttggctttaaaatagcacctgctccagggtatgaaggttctgtcacatgtgctctcatgtgttcagtcaaaggcatgaaaaagtaaaatccacgaaggaataattatgaaaatagggatatacaaacaatcaaagccaaatccccttcaatggctccaaagtcaaaccccaaataagaactctgtaattatactatgcatgtcatatccaaaccaatcctgtcatttagccccatgaattaattactttataattaacagttattgtttgggcatgtcaaatactggctcttcaaaatatcaccagaataacctgttgccaaggtaaagctacctgagtttagggtttagcactgtagggggtaactctaccttgacaaaatctgatagcattttaggaagggaaaggcaatgccaggatattgagactttaaagtctggcttagtgagaggggggaattgattaaaattaggtaaagattatgatgtaatggtttaaaattggtgagcgtggaaaaacagattgggagggaagaaattcaaaaagtctcagggtacaaggttcatgctttttgtcttggtctgtttggtctgctataacaaaatatcacaaactgggtggcttgtaaacaatgaaaatttatttctcacagttctggagactgggaagtttgaggttaaggtgccagcagatttggtgtctagtaagggcactcttcttggttcatagatggggtcttcttgctgtgtcatcaccatggtgaaaagggctaagtagttctctgtgatctctttaataagggcactaattccagtcataaggcctctgccctcatgacctaatcacctcccccaaaccacacctccttctaccatcactttggagttaggatttcaacatctgaatatggggggaaggtggggataaacgttcagtccattgcacattctattgaagagttgctggaatgagcagcaaagctatttgcaatttatatcttcctgggcaagagtcttgtggaatagtaaagcaatgttgatgaatacagtgcaacagtagactcatgttaatgaagaaactaaactgtgttggggtagatggtttgcttcttggaacctatgtactagaagaaatatatatgccctgctgctctccaagtacttcaggtattttaaaattcacagaggcaaaggccaagaattgagggaatagacatactattaggtttggagaatggtggacacattcatggagaagatagcatttgagctaggccctgatcactggacataagtttgtagagtttggatggtagcctgctgtttcaggctaaaggctactactgcttggctggtcacggcttcctttcttctttatgggttcattcggggcaagtaagggttttcattttgccatagtcctgtggaggaaaaatgaaagcagagtcattggttgaggtttaaactcttatttttgaaggctgctgggcgctttctgtagctaagtagcatgttttcttggctctgctttttataaatgaagctcaacatggagcagttttcttggttctgtgcattccttactttgaggatggcctccattagcatcacataaaaatcactaaaatagcagggaaagaagagggatgaggtggtttattggactcttaggattatgttgaagtatgcaaatccacagcagctgctcattctctcatcagagctttatgggttcctttttttccaaaggtgactgagctgagagccctgtttttgtcaaacagtgggttatagactccaggaagcaggagctgcaaagctccaaataactgtgcaagcattgattttcttttatttttgggtctctctgtttctctctctctctctctctctctcgtctcacacacactttttaaatggcagcaaagaggaagaagatctggtatgcagaatcagggaccacctaagtagggagatgaatgagaatcacctttttaggggttagaggtatgatttaggttttgggaatccaatcttaaggatatctcaggacaagttttaaaaacaatggacaaattaaggcaactttacaaatctgctcaggagactgatcctttagataagacaaattggtatttttaagccattctgagggattttcattccaatacctgtggcatttaatacattttcaagttcattttccaaacaagcgtctatataaaataccctcacagctcttgctaggtgtatgttacagttctccttaactaagctgaagatgcattgaagaattgctgccctctttaccttggaaatgaaaatgctatagctccctcttgtgtcgtgtgaggccaaacaacccctgattgatccacagcagtggaatctattccattagtgtcccaatagtatctctgcaaggctttttggggatgaggacattgatagaaggataagtaccaaggaatccttgtaggaccaccccaaaacattccagggagacctctgtcatactcctgctttttgaaaaatgaacttacccactactccgtagttggatcaataccttttcctttccagaattggacctgtggtcatggatgttcccaggatgaccttgacccaacaatgattgttggaataatcaatggcaagaagtaactgttttttattattgtgtccggaattggtgggttcttggtctcactgacttcaagaatgaagccgtggacgctcgcggtgagtgttacagttcttaaaggctgcgtgtctggattttgttcctgctgatgttcggatgtgtttggagtttcttccttctggtgggtttgtggtctcgctggctcaggagcgaagctgcagaccttcacggtgagtgttacagctcataaggcggcccgtctggagttgttcgttcctcccggtgggttcgtggtcttgatggcttcaggagtgaaggtgtagacctttgcgatgaatgttacagctcataaaggcagtgtggacccaaagagtgagcagtagcaagatttattgcaaagagtgaaagaacaaagtttccacagtgtggaagaggactccagtgggttgccactgctggctcgggcagcctgcttttattctcttatctggccccacccacatcctgctgattggtccattttacagagagctgattggtatgttttacagagagctgattggtccgttttgacagggtgctgattggtgcgtttacaatccctgagctagacacaaaagttctccaagtccccactagattagctagatacagagtgctggttggtgtatttacaaaccctgagctagacacagagtgttgattggtgcatttacaaaccttgcgctagatacagagtgctcattggtgtattcacaatcccttagctagacaaaaaggttctctaagtccccaccagatcagctagacacagagcacagattggtgcatttacaaaccttgagctagacacagagtgctgattggtgtattcacaatcctgtagctagacaaaaaggttctccaagtccccaccagattagctagatacagagcactgattggtgcatttacaaaccctgagctagacacagagtgctgattggtgtatttacaatcccttagctggacataaaggttctccaagtccccactagactcaggagcccagctggcttcactcagtggatcccacactggggctgcaggtggagctgcctgccagtcctgcaccttgtgcttgcactcctcagcccttgggtggtcgatgggaccaggcactgtggagcagggggtgacgctcgtcggggaggcttgggccacacaggagcccacggtggggagcaggggaggctcaggcatggcaggctgcaggtcctgagcctgccccacggggaggcagctaaggccgtgtgaaaaatcgagcgcaccgccagtgggccggcactgctgggggacctggcgcaccctccgcagctgctggtccaggtgctaagcccctcactgcctggggccggcagggccggccagccactctgagtgcagggcctgccaagcccatgcccacccggaactctagctggcccgcaagcactgcgtgcagccccggttcccgcccatgcctctgcctccacacctccctgcaagctgagggagccggctctggccttggccatcccaggaaggggctcccacagtgcagcggtgggctgaagggctcctcaagcgcggccagagtgggcgctgaggctgaggaggcgccaagagtgagcgagggctgcgagggctgccagcatgctgtcacctctcattatcataagctgtcagcttgtgatttgttttccttattcagacttcccagcatatttatttcaaggaagaatgtgaagagagtagtagatgggtgggtgggcacaaatagtgcagtttaccctcagatttccttcaaaggtcaagtgcctgagctttttgacagaaattgaaagacaaaactgatgcatacttaaccatctgctcacttgtggacttacttctttttgagctattttttttttaatggagcaataatctttgtttgcaatggctttggaagttttttgttttgttttgttttttgttttttgtaacacaggcccaggcttgagtgcaatcacggctcactgccacctcggcctcctgaactgatcctcccacctcagcctcctgagtagctaggactacaggaacatgccaccacacctggctattttttttctatttttcgtagagatggagtcttgctatgttgcccaggttagtctcaaactcctgggctcaagtgattctcccatcttggcctcccaaagtgttgagattacaggcatgagccactgctcccagcaggaagcacttgatatgggacaagccccagccccgcctgtctgctatggcagcgctccttagtcaagtgtcaggacttgcaagcaaagatgtcagtgaagggttagaaataggtttaccagtaaggacaagagagcacagtatagcaggatcagggctggaagttctgctgagcaaagaacgttgtaatgggatgtcagatatgagtaaagttgagggttactctggacagaaagtccaaactaagtaagattacacaaacagtgtgagggaaaaggacctgtgtgtctgggggcttcagtagcccaggaaatcttttagcactggtagctcagttatcattggcctacagtaggcttctaaaacttcctacaatctcacctttctttttacctaatgaaattttaaagcaagtgaatccctgtacagcacagtgcttaaggtgttcccaatccagtaccttctcaaaattctcatcctttttctggtccccccttcaatttgactactttctgatagcttaaaccacctccaccagttccttctctgaatgcttaagcacttattgtctgaatcagtttattgacaccaaactaactctgcccagaaatacttcgtacctttcctggattcctgtcagcactccagatatttgagggaattaaacaaaggccttttttttttcctttcctaactcaagtctagactgtgtgttttttaaggcttcatgttgctttactgtcaaaattggttccaggtcttccctcttactttttgagtatagtgtctagccattcacatgcttagagaataaggattcctagcagtgacaggcactgatactgtacacataaatacaattaatactgtgtcctcaataggtggaagcactccttgcttgccaaaaaagtggcagtttggttttctgttgttgttgacaaacttaaataaatattgagctccttggaggaggggccaagatggctgaatagaaacagtgccagtctgcagctcccagcgagaccaatgcagaaggcaggtgatttctgcatttccaactgaggtgcccagttcatctcacagggactggttaggcagtgggtgcaacccacagagagtgagcagaagcagggtggggcattacttcacccaggaaatacaaggagctagggaacctccctccctcagccaagggaaggcgggagggactgtgctatctggcctgggtactatgcttttcccatggtttttggaatctgcagatcaagagattccctcatatgtctacaccaccagggccctgggtctcaagcacaaactgggtggctgtttgggcagacactgagctagctgcaggagtttttatttcataccccagcagtgcctggaaccccagcgagacagaactattcactcccttggaaagggggctgaagtcagggagccaagtggtctcactcagtgggtcccggtcccatggagcccagcaagctaagaaccactggcttgaaattctcactgccagcacagcagtctgaagtcaacctggggtgatcgggcttgatgtggggaggagcatccacaattactgaggctttagtaggcggttttaccctgacaatgctaaggagactggaagatttggactgggcagaattcaccacagtgtggcaaaatggctatggccagactgcctctctagattcctcctcactgggcagggcacctttggaggaaaggaagcagccccagtcggaggcttatagataaaactctcatctccctaggacagagcacgtaggaggaagggtggctgtgggcacagcttcagcaaacttaatccttcctgcctgccggctctgaagagagcagtggatcctgacaaaggggattctcccagcacagcacaccagctctgctaagggacagactgcctccttaagtgggtccctgtcttccatgactcctgactgggagagacttcccaacaggggttgacagacacctcatacaggagaattccagctggcatcaggctggtgcacctctgggatgaagcttccagaggaaggagcaggcagcaatctttgctgttctgcaacctccactggtgatacccaggtgaacagggcctggagtgaacctcaagcaagctgcagcagacctgaagaagaggggcctgactgttagaggaaaaactaacaaacagaaagcaacaacatcaacatcaataaaaaagacccccacacaaaaatgccatccaaaggtcatcagcctcaaagatcaaaggtagataaatcaatgaagatgaggaaaaaccagcacaaaaaccctgaaaattccaaaaaccagaatgcctcatctcctccaaatgattgcaactcctctccagcaaaggcacaaaactaaatggagaatgagactgacaaattggcagaagtagtcttcagaaggtgggtaataacaaacccctctgagctcaaggagcatgttttaaaccaatgcaaggaagcgaagaaccttgataaaaagttacaagaactgctaactagaataactagtttagagaagaacataaattacccaatggagctgaaaaacacggcagaacttcgtgaagcataaacaagtatcaatagctgaatcaatcaagcagaagaaaggttatcacagaatgaagatcaccttactgaaataaggcatgaagacaagtttagagaaaaaagaatgagaaggaacaaacaaagcttctaagaaatatgggactatgtgaaaagaccaaacctattatttgattggggtacctgaaagtgacagggagaatggaaccaagtcggaaaacacacttcaggatattattgtggacaacttccccaacctagcaagacaggccaacattcaaattcaggaaatacagagaataccactaagatactcctcaagaagagcaaccccaagacacataatcgtcagattctccaaggttgaaatgaaggaaaaagtgttaagagcagccagagagaaaggtcaggtcatctacaaagggaaccccatcagactaacagcaaatctctctacagaaaccctacaagccagaaaagagtaggggccaatattcaacattcttaaacaaaagaactttcaacccagaatttcatatccagccaaactaaggttcaccagtgaaggagaaataaaatcctttccagacaagcaaatgctgagggattttgtcaccaccaggcctgcattacaagagctcctgaaggaagcactaaatatggaaggaaaaaccggtaccagccactgcaaaaacacaccaaaatataaagactaatgatactgtgaagaaactgcatcaactaatgtgcaaaataaccagctagcattatgataataggatcaaattcaaacataacaatattaaccttaaacgtaaatgggctaaatgctccaattaaaagacacagactggcaaattgtataaagagtcaagatcgttcagtgtgctgtattcaagaggcacatctcacatgcaaagacacacataggctcgaaataaagaggtggaggaatatttaccaagcaaatggaaagcaaaaaaaagcaggagttgcaatcttagtctctgataaaacagactttaaaccaacaaagatcaaaaaaggcaaagaagggcattacataatggtaaagggatcaatgcaacaagaagaactaactatcctaaatgtatatgcacccgatacaggagcacccagattcataaaaaaagttcttagagacctacaaagacacatatactcccacacaataatagtgggagactttaacacaccactgtcgatattagacggatcaatgaaacagaaaattaacaaggatatttaggacttgaactcagctctggaccaagcagacctaatagatatctacagaactctccaccccaaatcaacagaatatacattcctctcagcaccacaaagcacatattctcctttcagcaccacaaagcacatattctaaatttgaccacataattggaagtaaaacactcctcagcaagtgcaaaataatggaaatcaaacaaacagcctctcagaccacagtgcaatcaaattagaactcaggattaagaaactcactcaaaaccacacaactgcatggaaacagaacaacctgcttctgaatgactactgagtaaataacacatttaagacagaaataacgaagtcctttgaaaccaaggagaacaaagagacaatgtaacagaatctctgggacacagctaaagcagtgtttagagggaaatttatagcacgaaatgcccacatcagaaagcaggaaagatctaaaattgacaccctaacatcacaattaaaagaactagagaaggaagagcaaacaaattcaaaagctagcagaagacaagaaataactaagattagagaagaactgaaagagatagagacacgaaaaactgttaaaaaaaatcaatgagtccaggagctggttttttgaaaagattaacaaaaataggtagaccaatagtcagactaataaagaagaaaagagagaataatcaagtagatgcaataaaaatgataaaggggctgtcaccactgaccccacagaaatacaaactaccatcagagaatactataaacacctctacacagataaactagaaaatctagaagaaacggatacattcctggacacatacaccctcccaagactaaaccaggaagaagtcaaatccctgaatagaccaaaaacaagttctgaaattgaggcagtaattaaaagcctaccaaccaaaaacagcccaggaccacatggattcacagccaaattctaccagaggtacaaagaggagctggtatcattccttctgaaactattccaaacaatagaaaaagagggactactccctaactcattttatgaggccagcatcatcctgattccaaaacctggcagagacaacaaaaaagaaaatttcaggacagtatcactgatgaacatcaatgtaaaaatcctcaacaaaatactggcaaactgaatccagcagctcatcaaaaagcttatctaccacaatcaagccggcttcgtccctgggatgcaagactggttaaacatatgcaaatcaataaacttaatccatcacataaacagaaccaatgacaaaaaccacatgattatctcaatggatgcggaaaaggccttcaataaaattcaacaccccttcatgctaaaatctctcaataaactaggtattgatgcaacatatctcaaaataataagagctatttattgacaaacccatagccaatatcatactgaatgggcaaaagctggaaacattccctttgaaaaccagcagaagacaaggatgccctctctcaccactcctattcaacatagtattggaagttctggccagagcaatcaggcaagagaaagaaataaagggcattcaaataggaagagaagaattcaaattgtctctgtttgcagacatgattgtatatttagaaaaccccattttctcagccccaaatctccttaagctaataaacaacttcagcaaattcttaggatacaaaatgaatgtgctaaaatcacaagcattcctatacaccaataatagacaagcagagagccaaatcatgagtaaactcccattcacaattgctacaaagaaaatacctaggaatacaacttacaaggacatgaaggacctcttcaaggagaactacaaaccactgttcaaggaaatcagagaggacacaaacaaatggaaaaaaaattccatgttcatggataggaagaatcagtatgaacatgaccatactgcccaaagtaatttatagattcaatgctattcccatcaagctaccatttagtttttcacataactagaaaaaacttccttaaacttcatatggaaccaaaaaagagcccatatagctaagacaatcctgagcaaaaagaacaatgctggaggcatcatgctacctgagttcaaactatactacaaggctacagtaaccaaaacagcatggtactggtaccaaaacagatatatagaccagtggaacaaaacagagtcttcagaaataacagcacacatctacaaccatctgatcttcaccaaacctgacaaaaacaaacaatggggaaaggattccctatttaacaaatggtgttaggaaaactggctagccatatgcagaaaacagaaactggagcctcttcttacctcttaaacaaaaattaactcaagatggattaaagacttaaatgtaaaacctaaaactataaaaaccctagaagaaaacctaggcaataccattcaggacataggtatgggcgaagacttcatgactaaaacaccaaaagcaattgcaacaaaagccaaaattgacaaatgggatctaattaaactaaagtgcttctgctcagcaaaagaatttatcctcagagtgaacaggcaacctaccaaatgggagaaattttttgcaatctatccatctgacaaaagtctaatatccagaatctacaaagaacttaaacaaatttacaagaaaaaaacaaccccatcaaaaagtgcgtgaaggatataaacagatactcctcaaaagaagacatttatgtggccaacaaacgtatgaataaaagcttgtcatcactggtcattagagaaatgcaaatcaaaaccacagtgagatacaatcttacgccagttagaatgtgatcattaaaaagtctggaaacaacagatgctgtcaaggatgcagagaaataggaacgcttttacactgttattgggagtgtgaactagttcaaccattgtggaagacagtgtggcaattcctcaaggatctagaaccagaaataccatttgacctggcaatcccattactgggtatagacccaaagaattataaatcattctactataaagacacatgcacatgtgtgtttattgcagcactatttacaatagcaaagacttggaaccagcccaaatgcccttcgatgactgaatgaataaagaaaatgtggcacatatacaccatggaataccgtgcagccataaaaaagaatgagttcatgtcctttgcagggacatggatgaagctggaaaccatcatcctcagcaaactaacacaggaacagaaaaccaaacaccgcatgttctcactcataagtgggagctgaacaatgagctgaacacatggacacagggagaggaacatcatacaccagggcctgctggtgggtggggggaaaggggaggaagagcattaggagaaatacctaatgcatatggagcttaaaacctagatgatgggttcataggtgtagcaaacgaccatggcacatgtatacctatgtaacaaacctgcacattcagcacatgtatcccagaacttaaagaaaaaaaaccttaaaaaaatgagcttcttcaactggtacatatatatatatataattttttttagagggtcttgctctgtcacccaggctggagtgcaatggcatgatcacagctcactgtagcctccacctcctgggttcaagcaatcctcctgtctcggcccacatttttgtattttttgtagagacggggtcttaccatgttgcccagcctggtctcaaactcttgggctcaagtggtccacctgccttggcctcccaaagtgctgggattacaggcatgagccaccgcactcagcctcaactggtactttaaagctggaatcatttgatgatttctgttctgctgtgattctcctctactttgggacagaattgctttatctcttgtttctactctttacctgctgatccattattgtggatatttgcttaaaaggtctgtaagatttggatgtctcatttggaaaagacaagggaaagaaaggaaatgagagaaaaagcctaagaaatgcaagttgattctccatccagatgagacaggaaaaaaataataataataaaggaggcaggtgggatgttggctaaattagtctccacagatgaaaaaaatatggacaaaacatttttatttagcaccacatgtgtttgtggttttagctccccaatgttttctgtcataataggctctaaaagctggttctgtcatgggaggcattaccaaattctttggaaactcttccccttgggaccaacacttagtaccattctttgataaggtgaggtctccagctaatcttttgtgatttcccccttattttctgctctcctgcagtgtgtccaaaagagcctctttcttgcaggatcacatttttccagcaaataattcctttggatgattttcttgtaatccagttatctcccacttagtacatagaatcttgtaccatttcttctccaaatagagggagtagaacttgctttcacttttgcctccttttgccatgtcatgtgggattctttcagtatcatgacttaaccagtttcagtcaggcaccagtgtttttgcccctctaactccagagtaaagatgtcagattttcccatgactctcatactctactatcagtgtagcttacagattttggcttctcagtgagtatccagccagggtgtaagatgcagtctgaaatcttttgtaaatgattttccaattttactaccccttcccctacttgacttggacatgggaatcggggaaatgccacagtgttctctattaatgaatttccttactttaaatattttttttttttgtaagagacatggtcttgctctattgccaggttggcactatcacagctcactgtagtcttgagctcctgagctcaagagatcctcccacctcggtctcccaaagtgctgggattacaggcatgagccaccatgcccagccttctttaaataatctttgataactatattcttcacatgtatggtaattcttgtgcagtgtattatagttcttgttactcagttttgcatctttgccagtatcatgagacaagaagaaaagtctcattttataggtcctttaaaaatgatcaaagatactgattgttagaaagatttatagttttcaactatgtaggacacaaacttaatagaataattgcttcattaaagtgtgtatgcatttaaaatttgatagattgaggtgtacatctgtttagtctcctgtcttatttaaccttgccttcatgtcatagtcagcttgatgttcccataacagttctagcccattaatttcatcttttcctgacccgtcagcccttattttaaaactttagatgctgttttcctcaggaaagttaagattctttggtcctagcccttaaaggggtcctacttctccaactttatggtttctctcggcaaaggaaaatttggctgcacacacgcactgaaaataaatttatcctctgatagctattaactttgtggtcgggtaatataagcagcattgcagggtatcacaggcaaagtaacagtcttagaaaaagtgaatgattggtgaattctgaggcaggaaaactcaaacgtgggaatcatcgaaataaagtgtgacttgaactgggtctttagaaattaagaaggatagaactaagacaaaagtaagggaattattagggaattccaggcagagaggaaatgctacaaaaagctaagatagcagaaaatacatggacttttaggtaacactaactgaattttacttttttaattaagacattttccgttgcatggccattgtttgtatttatcttaaaacccgaggtcaggaatattttactgcttcatgtttggatatggaccatagttaatgtccatagttgactaggtatcaacatattttggttagtaagtgaataaacaaatgaattgcaatagttagcagaaagggctgcaaaatactaggaagattccaacaggagaagaaggattaatttcaagaaaacctcatttatcattatttcagtgtaacaaatacatgctttcttatgaaacagcactctttcttaatgaattcatatttaaattttggaaaataatctttgcattctgttttcctaatcaactatgttgtattaatagcactagcataattttaaaagaatgaaaaaaatgctctgccaaatctgtccctcagaaagggttcaaacttgaatagttcatgggaacaatttgctagtctagagaattcttcccattttggtcagggcctcctatggagagatttatgtgcagtgtatgtcaagagacaaaataatggcatttctctgcaacacaatgactcggacgtttgttgagtacagaaatgcacctttaaactagagaaagaaaaagaaagtctgccctgatccaatcattttgaaaagccatgcacactgaagctgggaccaaacataataacaggatttaattgctaatgctctagaggcagtgtgtctcttgatgtgttgacctttaacccaaacttgggagggtaaaaaaaagggaggggaggatttcctttccccttctgcctgctgtccccgactccctgcatctgatcatgtctgtctctaacgcagtctacgtgcccctaacattcaactctccacttccatttccattagttacttccagctttggagccgggatgagaatgaatagaagaacagaaaggaaggtgggaggagaataggagaagaaagtctgcaagcagttgacagctgcttagaatcaggggatggaattgtagctgctgaaatgagagctggacacctactcccctgatgcttctcccctactccgtagtattttgtgatatttaggccttttcatgtgtttctgttcattgttccattccaccctttctgggtccgtacttataatcatttttttctctacaccttcagctcccattttcctcttactcggttacttatgaatggcaaaatttcaagcaagttaaattcaaggctctgcctattacacacctgaaccatggcaactagacagctaaacgtggctggagaaaaaatatgcagattggtcttgctgtaaatatatgactattagcctaagtcagcccttggtgctactcagcaaggttactagtccattcagtctcccgctcttttacaaaacttccacaacttctttctcttcaattcttttaccatgctccagtcatgctggcctgctttctgtttccaacatgccaagtccattcccacctgaggaccttttcatttactcttcctcctgcctggggcaccctacatttaggtatttgttcacttccttcaacaccctgctgcatattgtcatcacgtgttaggccttcccagaaccccctatataaggcagcacatccccatcaccactgacaaattcagttcctctaactttgggtttttgtttgtttgtttggttggttggttggttggttggttggttgggtttttttcttttgcttttttgagacagagtttcgctctgttgcccaggctagagtgcagtggcatgaactcggcgcactgcaacctccgtttcccaggttcaagtgattctcctgcctcagcctcccgagtagctggatataaacagacacaggccaccatgcctggctaatttttgtatttttagtagagacaggatttcgccatgttgaccaggctggtctcaaactcctgacctgaggtgatccatctgcctcagcctccccaaattctgggattacaggcatgagccactgtacctagcctcctctaactttgttttctttagcagttgccaccatctggtgttctccatattttgtgtgtatgtactgtattttctatccccctgctagaattaaaatttttcgagagcatggattttgtggggttttttcattcttctatacctaaagcttaatgtaatgctttctagtactccatacatatttatttaatgaatgaatggatgcttgctggcttttgaatatcttctattcccaattgccaaacctagaatatcccttccctacccatcctcccatgtttttttgtattgtgcccctggtatgcaagtccagatttagtgcataccatctaactgttggagaaagtatcttttatttggcctgtcttaagaaatccaatgtaagtattttgtacttagaagtatagtctcacagaatggagtcctcaaagagagttctatgatcatttcccgatttgtttaatgggccctaatagaggaattggcttatccaagatcactaagctaagtgtagtttaaaataaatgtgagttgaagttgttttgcttttcaaaactcttgcttgggattattggagatacccagaaatggttagaaactcatatagtcattacctggctccgtctttccacttactgcattcatgggttggcacaccacctcatgggtacttcatttttattccgtgagatttgcttaggtaacttagcgggatttctcagtatatctttgttctcttcacatgttttcatgaagttgtgaaaaaatgataattaaaacacacaccacctgtaccacactgccatatatcttgaccttaacctattcagtaagataaacacatactcgattttatataattgatgacagtctgtactcatgtcagcagaggagaactgacctagaaatgttagtttctcatagtcattgagcctaacgacccttctagaggttattaatctgcctccaggccatagctccctctaaacttttcaaaacaaatggttctcttcttaaagcatcatccatttcaccaaaatacttgaaagaaaataatttttgtctcgttttcttatttttattactctttggtaatgtacactttgggattgagaaatgcaaattcagatttgaaaggtatatacggatttgtcttcaagttcttctacctcttgaaataatgaaagcctgagtggtgtgagatataaatggaggatacagagggtaaatactccaaaagcaacacaaaccttcattaaattacaggagtcccctcttttattgtgacgattacacagtgatgtttagagtctaaatcatttaggtacagtgaatcctcacatccattgtgtccctgagagcaccggctgcaatacccaacattgagcagatactcagcaaatcataatatgcagacagcatagagtagatgctcagcaactgtctcagtgaacacgaagatcaatgtagagtgaattagtaaattaataatggagcagacatttctattagggtttttttttaactggacaaccagctgcttggcaccatagatcatgcctccaaatctgacagaagtggtacagttttgtgagtgtctggctatcctttgagtctgaagtgttgcactagtggttgatcaatcaaattgaatggattgaatttgtaggtaaaatgagagaaaagcctgttggctttcataacttttgaatgcagctgtcatctatacgttttgaatctggtgtgggggtgagaaaggaggaggaatgctgaagtttattttaggctgtatggaatagtcacatagtgctcttcaatggagtcttggagaaacaatacattttagtttaaaatactctcaaagcaagcaatcaaggcagaatgaagaacaggatttaagcttgagatgtcttagggatgtaggcagtggttagaccactcaacttgtacatcagcaagatggttcttaacctttactttccatgctcagtgggctcaaataagcctcctttcatctggaatgaaatgtagtcaggatggactgtgagaaaggaatgtctcttaactgtatttttgagggcagagagaagaaatatcaagagggtcttagattatttcatctaccaatagaaagaagataataatttttgataaatacagatgagctgggtgcaaaattttaaaataagctgcaagtggttctatggttgcaggttctctcaagttgttgaaataaaaaggaacaattaagactgccttttctgtggagagaaaattgtttaaatccttacttagcatctatagtaggacagtgaaatagaaataatccagagaacttaaatttgtgctgtgcttgaatgtttttatggccccatttctaccatgaaaaatataaccattctcttacttggatgcatatgcactttcgtatatggatggatgccatctctatttcgctgaacataggttgatagatgaaatactttataaaacaaaaatctcattaatttatgtttcaccaattttaagattttgataatttggacagggactgagcagaagtttccttcagtattattcataaagatggggtttgcttaagcaagttaatagcatagagaagattcaggaagaatatttaactactgaggaggaaacagcttccaactaattcttggatgtatactttctgatgcaaacatttgtagtgctgtctgctaacttattcagtaattcacattggctccagagttgttcagagattctgattttcaataattaagtacatctaattcttcctcactggttttgaatacagggagctagctccggttaagtgggccttatagccagagttgcctgcaggagcctcactagcctatatatctaatgggtaagaagttgttattcttaaacttttgttgaatgagcaagtacaatgtaatgatgttccccagtgccaagtgaaatataggaacatagctagatttggagggaggtagactggtttactttgagtggcccatatatgagatcctctagaaatcaaggaacaattcatctgttactgagttgagggccacatagtgccttcactttctcattcacttattgtagttgccccatggggtcattctgtgacaggaagattagcatattgtatgcatgcacttgagactctattgagtatactttcagttatgtactgaaagtcttccaagtgtttcatgatttcaattgaagttgggaaattaatcagaatggagtccagtattttggtggaaactacatgtagtgtatgagtgtagagtttgagttttgttgaagcaaagcatttctgtaatagtttaaagaatgtttcctgatttttgccatagtgtgcttgtcttgggaatcaagactctgccttcatgcagccatggaaggctctcaaaaggcattggtctcgttactgaagagctggatatctagaacctgaactagactctagtataaaaccaatactagaaataggatcattctgtgtagagaactaatgaactatttctttggtgttgtcttcacagctgaacttgcaaaacagattggaacttcaagattatcaataatcggagatacgtatattttatttgtaaagaaaacatggctgccctattcctacgtggttttgtccaaatagggaactgcaagactgggatatctaagtcaaaagaagcattcattgaagcagtggaaagaaagaagaaagatagactggtgctgtatttcaaaagtggaaaatatagcacttttcggctaagtgataatattcaaaatgtagtccttaaatcctatagaggaaaccaaaatcacctgcatttaactttacaaaataataatggcttgtttattgaaggattatcctccacagatgctgaacaattgaagatattcttggacagagttcatcaaaacgaggttcagccacctgtgagacctggtaagggtgggagtgtcttttctagcacaacacagaaggaaatcaacaaaacttcattccacaaagttgatgagaaatcaagtagcaaatcttttgagatagcaaaaggaagtgggacaggtgtccttcagaggatgcctttgcttacatcaaaattgacacttacttgcggagagttatcagaaaatcagcacaagaagaggaaaagaatgctctcatctagctcagagatgaatgaggaattcttgaaagaaaataattctgtagaatacaagaaatccaaggcagattgttcgaggtgtgtaagctataatcgagagaaacaattgaagttaaaagagttagaagagaataagaaattggaatgtgaatcttcatgcatcatgaacgccactggaaatccttacctagatgacattggtcttctccaagctctcactgagaaaatggttttggtatttctgttacaacaagggtatagtgacggttacacaaagtgggataaattaaaactattttttgaattatttccagagaaaatatgccacggcctccccaatttgggaaacacctgttatatgaatgcagtgttacagtctctactttcaatcccatcgtttgctgatgatttacttaatcagagtttcccatggggtaaaattccccttaatgctcttaccatgtgcttggcacggctacttttttttaaagatacctataatatagaaatcaaggagatgttactcttgaatcttaaaaaggccatttcagcagctgcagagatattccatggcaatgcacagaacgatgctcatgagtttttagctcactgtttagatcaactgaaagataacatggaaaaactcaacacaatttggaagcctaaaagtgaatttggggaagataattttcctaaacaggtttttgctgatgatcctgacaccagtgggttttcttgccctgtcattactaattttgagttagagttgttgcactccattgcttgtaaagcttgtggtcaggttattctcaagacagaactgaataattacctctccatcaaccttccccaaagaataaaagcacatccttcatctattcagtctacttttgatcttttttttggagcagaagagcttgagtataaatgtgcaaaatgtgagcacaagacttccgttggagtgcactcattcagtaggctacctagaatccttattgttcacctcaaacgctatagcttgaatgagttttgtgcattaaagaagaatgaccaggaagtcatcatttccaaatatttaaaggtgtcttctcattgcaatgaaggcaccagaccacctcttcccttgagtgaggatggagaaattacagatttccaattattaaaagttattcgaaagatgacttctggaaacatcagtgtatcatggcctgcaacaaaggaatccaaagatatcctggctccacacattggatcagataaggagtctgaacaaaaaaaaggccagacagtctttaaaggggcaagcagaagacagcagcaaaagtaccttggaaaaaattctaaaccaaatgagctagaatctgtatactcaggagatcgagcattcattgaaaaagaaccgttagctcacttaatgacgtatctggaagatacctcactttgtcagttccacaaagctggaggtaaacctgccagcagcccaggcacacctctctcaaaagttgactttcaaacagtgcccgaaaatccaaaacgaaagaaatatgtgaaaaccagtaagtttgtagcttttgataggattatcaatcctactaaagatttgtatgaagataaaaatatcagaattccagaaagattccaaaaagtgtctgaacagactcagcagtgtgacggtatgagaatctgtgaacaagcccctcagcaggcactgcctcaaagctttccaaagccaggcacccaggggcacacaaagaacctcctaagacctacaaaattaaatctacagaagtctaacaggaattccctacttgcactgggttccaataagaatccaagaaacaaagacattttagataagataaaatctaaagccaaggaaacaaaaagaaatgatgataagggagatcatacctaccggctcattagtgttgtcagccatcttgggaagactctaaagtcaggccattatatctgtgatgcctatgactttgagaaacagatctggttcacttacgatgatatgcgggtgttaggtatccaggaggcccagatgcaggaggataggcgttgcactgggtacatcttcttttacatgcataatgagatctttgaagagatgttgaaaagagaagagaatgcccagcttaatagcaaggaggtagaggagacccttcagaaggaataagaggaacgtactcctccttgtacagatctgcctgactgtctcactcgataccacttcctccatggaaggaaaactgtgaactttatccagagatgaaaatgcaattagtctaggaccaaaggtcaaacagaaacacttaatggggagatctgcattctaatcctgacacagacacctcaatcccatagctctggctgatgagcatccttctctcctacaagactgaaattgtgtttttcatgttcttcttcattttaa

SEQ ID NO: 984 - DNA, 448 bp, mus musculus
gccatggttcacagcaatgtgctacgatccaagatatcagccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcactttcaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagt

SEQ ID NO: 985 - DNA, 521 bp, mus musculus
gacagaatgtgagggcacaagcaggcttctgagccacttgtcagattgtattcaaagcatcaatccaagaaggaggttatgtgtacttcatttattggtgatagttggaagagactgcagactactgctttgaatgagttgaattacataagctaagatcactataggtccatttcttgaacccacttatacataaaatgtaacccatttagaaaaagattctggatatcatcccccttgaaagatagaaagcattcaggatgtcccagttatcacatgttcacacttgggtttaggggtgtttttttttaaaaccaggcaggttagctagcccaccctgtgctagttttcatgttcacactgaccctatttgaattaatatcctttgttagagtggtcgagatttcaaacccaattatgtacagggagctgtctgagagctagccagaactggggtacagcctgggctcagggaatagctgtcaacactcgggcaaagtttttgtctgtgcatgtgtatc

SEQ ID NO: 986 - DNA, 3231 bp, mus musculus
tttcacatgtgcagagagtaagtcgtgtttctatttcttccctcctcgggccttaggaacactttcaatctagcggcgaggtggcgcgcatgcgcgcgccgggtgggggacacccctgtcccacggctccgtgggcctcgtcgtctgtctccggtggggggctgaggcgagcgccgcgggagcgagatgggacaaggtggtagtgagtgcgccatcctggcccggatgccggtggcacccgcaccggctccggccacggcctctgcctgggccgctgtcccaggcgcgcctttaattaaggactccagcttgggggaagagagaagggaaaatgccgactgcggtccgcccgtgggtaactggggctcggtggggttttcgctttggcggggtgggggttccgtttcctaattcctgtgcgggccgggtgggcgggggcgggcttttttccttgggctattaaaggcagaggggcgggcttttcccagggatatagctacggacagagggccaaggggacggagcgctcctcaagtggtggcagggaggctcgtggccccgcgtcgctctggacaggggcgctttggggtgagatgtgcgctcgcggccttgatccatttagtggacgctttttctcacttctcttccccttctggctccgcgggagactgcgctcgcacccggccccggagcgctcgagctgcgcgctgggacactgggtatacgtgtggaggggacacccggagagggcggcccgtgcgggatccccgcgctctccacctgcgaggggcgggccggagctgggtcccgcgcgcggtttcccgagcgggtggctgggcaagaagggagcccttcgttggggcagctgtgatccggtagagttgactggttgggtgggaggggacggagcgggcgggacttgagaaaagcaaagtaccagagtgcggttgaggggtagcgggcagcgcgcgggaaacgactccccttttcttctccaccgttgacctttaggttcctggaaaactttggtggtgagggtgtgaaatgagggggtgcacgtggagggaaaaaagggactcccctccctcttggcttctatcccaccaacccgggaatggagggggagggaggcgtgggcttggcgcgtttttggtgctttgaatggagaactccgtttcccatgatgctttgtttctttctctttaatttcggcggcggctgaggctgcacgaggactggagcgcgtggtgtgagcagctggagcacaccctggacgcgcgggctgctcgcggacttcaacgggagcattaggtaagggtgtgagagacgcgggaagaggcaaaagggagccacaaaggcgtacagggaaggacttctttctttcttttccttattattattattattatttgcaatttaaggggattggagagtgactgcccagcgtgcgcgagggatgccagatgaaccgctaattagcaaaaggtagtaactagaagggcgccctgtctgatggctgtggggctcagtttggccaggttgggttggcaaatactatgcattttgagtcaagtttggagtattttttttttaatggaaaagaaatcttcacaggtgtagaaacccaatttaaggggaaaaatgttatttttctcatttctatactaaatccattcttccctaatagaaaattgattccagattgatgtataagttttataaatcagtttagtttgtaaagacttctaaagactcatttagtggcataagatatcgtgacgaaagttcaacatttaaaattccctcactcgtttaacgtattacagattctgtcccaaacgtttttgtttttcttttaaacaaaagttaccccatcatggaagagataggggaccctgtgagcctttttcacatagaggctcacttccttgctgtatgttcttaggtaaaataagcacttggaaatgggagaaggttttcttatggaagataatgacatgaagggaagaagagctaatctgcctactttggtttaatggagaaaatgggtccataaatgtttaaacagaagtagagccctttgaaatagatcaaaatgtgacatctctcagccatctgtgcattatgtgaagactgtaaggctgtgtttcttaaaccagctctaaaatttctctcattttctattaatggggtgggggctgggaatattcatttaatctaacagtcactttccgtatggagcccaaaagctctgaatgatctgaagactcgaatactcatcctgggttttacatgctcctttctctaggtcctcctcttataaaatcagggtggatagaatgtgcctgcaaattactgagatgcagatatcaaattttcttagatggagagggggagtccaaaatctgcttatacataagaattggactttttgcagttgccagtgttattcgtgttcaattctgtgtaaataattgagattattaatatttctcaggatttggttgaaaccacaaaacctagcttagactctgtaagccaaaggaaagcctgtttcaggaatattaactagtagtttacttgtttagtttctaatatgtgtgtgtttgttttgttgttttaaccaggtgagtctgcatggatctgtgaggacggaaaagaagagctcctggaagacttaaaattttgctacaggaataggccttggccatgtaaaagtgcttacagtgcaggtagctttttgagatctactgcaatgtaagcacttcttacattaccatggtgatttagtcaatggctactgagaactgtagtttgtgcataattaagtagttgatgcttttgagctgcttcttataatgtgtctcttgtgttaaggtgcatctagtgcagttagtgaagcagcttagaatctactgccctaaatgccccttctggcacaggctgcctaatatacagcattttaaaagtatgccttgagtagtaatttgaataggacacatttcagtggtttgttttttgcctttttattgtttgttgggaacagatggtggggactgtgcagtgtacagttgtgtacagaggataagattgggtcctagtagtaccaaagtgctcatagtgcaggtagttttggcatgactctactgtagtatgggcacttccagtactcttggataacaaatctcttgttgatggagagaatattcaaagacattgctacttacaatt

SEQ ID NO: 987 - DNA, 2227 bp, mus musculus
gggatatagctacggacagagggccaaggggacggagcgctcctcaagtggtggcagggaggctcgtggccccgcgtcgctctggacaggggcgctttggggtgagatgtgcgctcgcggccttgatccatttagtggacgctttttctcacttctcttccccttctggctccgcgggagactgcgctcgcacccggccccggagcgctcgagctgcgcgctgggacactgggtatacgtgtggaggggacacccggagagggcggcccgtgcgggatccccgcgctctccacctgcgaggggcgggccggagctgggtcccgcgcgcggtttcccgagcgggtggctgggcaagaagggagcccttcgttggggcagctgtgatccggtagagttgactggttgggtgggaggggacggagcgggcgggacttgagaaaagcaaagtaccagagtgcggttgaggggtagcgggcagcgcgcgggaaacgactccccttttcttctccaccgttgacctttaggttcctggaaaactttggtggtgagggtgtgaaatgagggggtgcacgtggagggaaaaaagggactcccctccctcttggcttctatcccaccaacccgggaatggagggggagggaggcgtgggcttggcgcgtttttggtgctttgaatggagaactccgtttcccatgatgctttgtttctttctctttaatttcggcggcggctgaggctgcacgaggactggagcgcgtggtgtgagcagctggagcacaccctggacgcgcgggctgctcgcggacttcaacgggagcattaggtaagggtgtgagagacgcgggaagaggcaaaagggagccacaaaggcgtacagggaaggacttctttctttcttttccttattattattattattatttgcaatttaaggggattggagagtgactgcccagcgtgcgcgagggatgccagatgaaccgctaattagcaaaaggtagtaactagaagggcgccctgtctgatggctgtggggctcagtttggccaggttgggttggcaaatactatgcattttgagtcaagtttggagtattttttttttaatggaaaagaaatcttcacaggtgtagaaacccaatttaaggggaaaaatgttatttttctcatttctatactaaatccattcttccctaatagaaaattgattccagattgatgtataagttttataaatcagtttagtttgtaaagacttctaaagactcatttagtggcataagatatcgtgacgaaagttcaacatttaaaattccctcactcgtttaacgtattacagattctgtcccaaacgtttttgtttttcttttaaacaaaagttaccccatcatggaagagataggggaccctgtgagcctttttcacatagaggctcacttccttgctgtatgttcttaggtaaaataagcacttggaaatgggagaaggttttcttatggaagataatgacatgaagggaagaagagctaatctgcctactttggtttaatggagaaaatgggtccataaatgtttaaacagaagtagagccctttgaaatagatcaaaatgtgacatctctcagccatctgtgcattatgtgaagactgtaaggctgtgtttcttaaaccagctctaaaatttctctcattttctattaatggggtgggggctgggaatattcatttaatctaacagtcactttccgtatggagcccaaaagctctgaatgatctgaagactcgaatactcatcctgggttttacatgctcctttctctaggtcctcctcttataaaatcagggtggatagaatgtgcctgcaaattactgagatgcagatatcaaattttcttagatggagagggggagtccaaaatctgcttatacataagaattggactttttgcagttgccagtgttattcgtgttcaattctgtgtaaataattgagattattaatatttctcaggatttggttgaaaccacaaaacctagcttagactctgtaagccaaaggaaagcctgtttcaggaatattaactagtagtttacttgtttagtttctaatatgtgtgtgtttgttttgttgttttaaccaggtgagtctgcatggatctgtgaggacggaaaagaagagctcctggaagacttaaaattttgctacaggaataggccttggccatgta

SEQ ID NO: 988 - DNA, 2227 bp, mus musculus; identical to SEQ ID NO: 987

SEQ ID NO: 989 - DNA, 2227 bp, mus musculus; identical to SEQ ID NO: 987

SEQ ID NO: 990 - DNA, 2227 bp, mus musculus; identical to SEQ ID NO: 987

SEQ ID NO: 991 - DNA, 2227 bp, mus musculus; identical to SEQ ID NO: 987

SEQ ID NO: 992 - DNA, 55516 bp, mus musculus
cgctctgtgggtcgtgtgcgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccggtgagtccccacggaaccctggggccccccattctctccccggcgggagaagacaaggaggatggcggtggccaggccgccgcccctgcccgttgttaaaggggactcttggtggtctcgctttattgtcagggaccccagaagcgccgctcattgtaggcgcttggcggagaggctgctgagaaagtgctttggaggtgcagaaggagaggttaggcttacgcctagacttcgggggagggggcgcaacatttgaggagggaaaaaactgggaatttttagtttttgccattgcttagaacatatttgggaaagagggagactcccagtttgggaagagtaagaggaagaattgttaggatggcaagagagagagccttacggaatgaggaaaaactccggggtggggggaattaggggtgaaactgaggtataaggggaagcttacaacgaagactgtgagagggctaactcttgggggagggggcataaagaaagtggtaggatgatattttcctagattcgggaggattggaaaaggacgattaggggaccctgactttacgacggaaaggaacctgctgaagtgttttaggggaagatagttttgtgactttagcgcttgattagagggagatcttgggagtctagtgtgtattgggggaataaataacggagaggatccggtactttatgtgtaccgtctttcattatatggatgaacaccacggtattcttttccaatttccattcgttttgatattctgcgtggaagttaaaaaatcttttgtttttagaaaatcttttattttcatcgccttactacctaatgtcaggtcttatttatactgttcaaattctttctctacccttgggtttgaaacaactggaaaattcctttagtttccttttgaataaccgcaaaaagcagtgcgaagcatgtaataatatcgtgcaaccaaattcaggtgcccttccggtacatcttattcgtttatttctgtccactgtaactttcctgttagaaatactgcttctttggggaatcacgtttgttatctgttttgatttgtatatttcagcttgctttcgcgtggaatgttttaatcttccggaactgcagtttttgttgttttgtttgtttttctgtgaaaatgctttttcagataccaggcattgatgagctctggagttggttcttgaatgctctctctgatgtttcaggttatttctaccttggtgcttcgcagcatcttggaaaatcagaaatgcattgattgcttcagcttaactaatctagcttttattttttttccaggcatttaaattatgtatttcacgctgttattgttgcctctttatttctgctttgtagtattttccataatgcgatgtttcttttaaagaaaagccttcattgttgcgtgaaagcatcaaactttgatctccgcatggcctgaaaaaccttttagactaaaattaaaatgccatatagctgtggatcattatgaaccccttagtattggtccttggaatgcccttattctgcttaagtagagaccacaaatgtgacaacattagataaaaatctgtacttttatgataaagacatttttgctaggagtcattgtttccatgatgttctccacttcatgttttacaaggagactaaaaaaattaccaagatatgcgcagatgtattatttgaattttagtggaaaaatccatttagtcattgcacattggggaaagtttttaattggtttggtgcactttttttgtggctcttcttactttacaaattaaatttaagctgattacagaaaaaatacactagaatattttttaatgcaaaataaagtgtaccttttttctcttttagatttttggggtctttgatatctagaaaagcaggttctcaaaattaggatgagaaattagcctgtttataaattggaagaggcagaattaaatatagacagaattttggggatgccatttcggaattaattttaagaatacgaagtgattttttccattctagaaattttctttatcttaagccagctttatagccagtgctaggattgtatggaaattacacattaaagatgtctgtacgggatttgatttatactgtgccatcctttcaactggccaggatgaccgggagtaatgctgaatacattattatggtgatttcagagtgcgtactattcattgcatagtagtaaagaaactaatttagaactcaaaatataatagcaaattctgatgctatttatgaattttggtattttgcatagttaattctaaaaatttgggcaggtatactcttgataaagcaaccgaacacagatacttgcctgagcaaatgcaaacacacttcccttttgtttcttttgtttctctgttatgtcctttttttttctttaatcctaaaagtatttgctgcctgttttcaatcagtttcacggtttatagccagtgctatgaatacagtactatggtaaagtatccgttgtcatttggacgactgagatatttaaaattatagatagcattaagagtttgttaaacctatcaaagcagagactgtcagggcctttgaagttgtgttaaaaagaaaattctagacataaatggatgagaagacatgttttctttgtggcttcaggtgaaattttgattaagtatctgaattttatattgaaaagcactgaatagtttgtagatattaccttcctagcatacagctgctactgttcttgttggtgaacgaatgcttctcagctgcaatgtagtgttagacaattttttttcaacatagtattatgaaactgttcaaatgtatagacaaattgaaacaatttagtaaattaattttaagacaaaagtttgagatttttcttgattgtgacgtgtgttgtggcaacctggatcttgaactgcttagtcctgttgatttgggaaaactgtacaaatcaagtaactggttttaaatttcttctgaagaatccatattaagattgatgatctaaatctgaaacctttcatgttagagctttccttccctttttttgactacactgtactacctataattaaaatgtgaccaaatttaaggctcattcagaaaaaaatttcttcctttacacaatattactaatttaagtacggaagttactacatttagaagaccactatcagtttgtgactttaattgataagcaggcttggagtaaatcttagtcatataatatggttgttttataaataattgggtcttaaagtctgcatttttaaatagactgtcagaagcctaactttttatttacttgaaaatggaatagaatagcaaaaattaatttattaaagacatattcctgatttttttaaactcagaaataatttttaaagtgcaccaaagtcatagttaggtaaattcgttttacttttattgttttatcaatatgtgaactttaagaaattgttcaattacagaattctgttcccacggagtattctgaagtttccttagtagcttttaccgtgttcttaagaggtataattctttatcgccttgaaagggcacctagttacacatgaaaatattttacattaattatgccagcaggggataatttaatattatacattgtacatttctctccacacagaactagtgtcagttatttcacatatcctccaatttggaagcagtttgatttttctcaattactctaaacttcatttagctgtctgttatctatctatctgtatttattacggaggcatcttaggttttaatgttaatttatgtatactaaataaccatttaaaaatgtatatattaaaacctatgtcaaacaaacaacttacatgagtatgtataaactgattttaaaacaaaatgaactttgttacccttcttattctctgtagcatttcttggggcttagagtggcttaatttgtctatactaaataaacatttaaaaatgtgtatattaaaacctaggtcaaatttttaacaactttcatgaatatgtataaactgattttaaaataaaattaacattgtcgcccttcttattctctgtagcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatggtaagtataccggcagcaacagagaccttgaaacgattcatgagactcttaataacacatgaatgttcctgaatactaaaaaaaaaaacaaaaaccaaaaaaaactcagttaaattttaagaaatggtttatcactaatgctatgccatttttactagaaaattaccatttaaatttgacatcttatttactgttttactgtgattaatttatatatgaaccttaattttttttaaatgtaatttatagctcttttcatctgctttggtatcatcacactctgataatgaaagtcttggtggattttctattgaagatgtccaaaaggaaattaaaagaggcacgaagctggtaagttggtatttctgcctcttgagaataaaaattatttaaactcattaaagaggaaattgcttattttagagtgtattgcattattaactgagtataattttaaattgcaggcttttctttttttttttctctgagccagcaaaatccaaggccgggtttatcttatttaccactcaacaaaaaggaatgagtcaatatttatactattcaattttttttgcttttcaaagagaattaaaatctttttggaggctgtttacttagaaaacaaacagtttggttaatttgagtatatattgtgttaaagtcttcattcaagtttatttttcataattctgatatgttttcatctccatcataaagttatggtcattacaaatgaacatgacagtagcctctcaaaaggaaaatattagcacttgctgaacaaagtattttactgtagttcagctgtataacacaacatttatgactttggataactttcagtgaatttcacaggagcttttctgaagctgcgttagagtaatgttcccgtagttgtcttcactaccaataaccatattagtaagatattacattgctctgttggaatagtaatgtcatctcagttggtacttatgacacattatggtttactttgaaacgattattttttgtcttttttgtttccttcctttttgtggagaacgggatctcgttatattgcccaggtaggtctcgaactcctgggctcaagctgtcttcccgcctctgcctccctgagagctgggattacaggcgtgagccactgtgcccggctactttgaaacaattaatgggaagatttatttttatttttctcatttgaacactttattaaaattacatccataaatgcacctttaatagctttgctatccagtttcattttttaaaagatgcgttttgccaaacatataactgcgtttgtagttactaaataacctcttatttcacaaagactctgagatggtagtttttggatgaaatggtaataggaagaggggggctatcattttgatgatcaggaataatatgttttgaaaagtagtcttctattaatcgttttacataaaaagcaatatgaagaaatatgggctcaaaaatgacatttgggatttgctttaggatagtctcaaatcctagtatcagtattagtacaaatgagaattcagaggtcaaaccatttctgttgtagtgagaccttaactgtgaaaatgtttatcttccccatccccaaaactgtagatattaatagaaagctctggggtttttttttcctttttcttttcttttcttttctttttttttttttttttttttttttttgagacagagtttcactctcgttgcccaggctggagtgcagtggcgcagtctcagctcacggtaacctctctctactgggttcaagtgattctcctgcctcagcctcccaagtagctgggattacaggcatgcgccaccatgtctggcgaattttgtatttttagtagacacggtgtttcaccatgttggtcaggctggtcttgaactccagacctcaggtgatttgcccagtttggcctcccaaagtgctgggattacaggtgtgagccaccacgcccagcctagaaagccctgtttttcaaatgtggattttatttggtggttttaggtttcttcacgttactgtgctgatttctgagaaccatagcactatgtttttatttcctagtccttaaaataaatgcagatataaaaaagaatgatacttacttgaaagtgattgtgctgtaaaccttattacccctttatttattgcttgacattatgactatccctggaaaatatttctgtatcctgacttgttagcattttgtcacttgacacagcttgtatagtcagaacaaaagcagttttggtccctaatgttgaaacattattaacaaatgcaatgcctagtgttacactacatgaagcaacagcatacatctgtcaatattgcgaagttcagtggagatttaatttatttggacctttttttttttttttttgacagagtctcgctctgtcgcccaggctggagtgcagtggcgtgatctcggctcactgcaagctccacctcccaggttcacaccattctcctgcctcagcctcccaagtagctgggactacaggcgcccatcactgtgcctggctaattttttgtatttttagtagagacggggtttcaccttggtctcaatctcctgacctcgtgacctacctgcctcggcctcccaaagttctgggattacaggtgtgagccaccgcgcccggccttggacctattcgttaaagcatcagaactttgtatgagttttactattataaattgttttgattaatttttagtgttatagtgtagggagataattttttccccaaatgtagtgtgttacaaataacgaaatttgttccttgatctagggaatggaacaatactgggaattgagaacacaagctttagtgacagacttgagtttgaatcccagctctgtcatttactagctaggtgatcctgattaagttatttacttctccaggccatgttttcctcacctgcaaaaggggttagataatgacagtacttgcctcccagaattattgccagaattaaaagaggaagtatataggatttaaggtggtgctgggcacatggttaggacttgataaatagtagccaccacttattgtttttgtttgtttttgtttttgagatggagtcttgctctgttgcccaggctggagtgcagtggtgcgatctcggctcactgcagcctccactgggttcaagcaattctcctgcctcagcctcccgagtagctgggactacaggtgtgtgccaccatgcctggctaatttttaattttttttttatttttagtagagacagggttttgccacattggccaggctggtcttgaattcctcacttgagaccgtctgtccgcctcggcctcccaaagtgcggggattccaggtgtgagcactgaggaatagtggcagaagggaagaacttttgctccgtttccttcccttagaatgtcagtttaaacaacttatataggggataggaatgtaacatacgtttaggtttgaaataatttttgaaactccttttagccttcagttttgcttctttcattatatcatttttacatgatgtgctatcaggtaaccaaaattctagatttaagtttgattctctactattccctgtgtcaatttgtctaagcaataaaagggctatgaatcaaataggaggggggaaaaagagtgaagagcttaatgtaactagataaactgcatataaactaggtaatcagcttccctaattgacattttttttttttttttgagatggagtttcgctcttgttgcccaggctggagtgcaatggcgcgatctcggctcactgcaacctccgcctcctaggtacaagcgattttcctgtctcagcctcccaagtaggtcagattacaggcatgtgccaccatgcccagctaatttttttgtatttagtagagacggggtttcaccatgttaggctggtcgcgaactcctgacctcaggtgatctaccagcctcggcctcccaaagtgctgggattacaggcgtgcaccaccatgcctggcccctaattgactttttaaggcattttatcccgtgagcctgtttgctttggctcctgttcatctggatttctaggtgaaaagtaggtcatgaacactcattcaaaatcatcgaaaactggagtactgaaccctgagtgctttcaagacaaatttcaatctgtacctggtgttgactccaaagttgctcgcttgccccaaagaaaagaacagagagataaggaggctagggcttgaggttaaagtgtacgtatcaacagccaggtgggtcagagttgaggatgagagggctcagtagagcaggaggtgtgagtgtttggtttttatgttcttgctgccacaggcaattttccaaggttcatgtcagccacaaggatcaaaggaggaaagccattctgcatgaacattttcatctcctttacacggtctttaattatatagcaccaagatggaccaggaaaaatttgccagagtactaaggcttttatgatttgatgccctgtttttgcagtttagacagatatatatttttccagtatgatttccagtttctactgaagccatatggagataccacatctgtaccatctattcttacttaactccagtcatctagccaagaaatgcaaatttccaagtaaaattatgagttagcactgcttttttgaatttaaggagatacttgaaagaaggatatttgaagaatttaccgtttctggatgaagctagctggtgagattactaagggtatctactatctacattggatagctattcttctttttttttttttttttttaagatggagtttccctcttgttgcctaggctggattgcagtgacatgatctcggctcactgcaactccgcctcccaggttcaagcaattcccctgcctcagcctccccattggctgcaattataggcgcccaccaccacgcccagctaattttttgtatttttagtagagacagggtttaccacgttggccaggcaggtctcaaactcctgacctcaggtgatccgcctgcctctgcagatagctattattctaattggtaccggtgtcagattatatcacagattacaagaagagaaagagttcagaaggccatttagttcacctgtcttacccctatgcaagatttcctacaagccactcaagataagatttttggcctaaggattggctgacacgtgtaatcctagtgctttgggaggccgactgggaggattgcttgaggccaggagttgaagaccagcctggacaacaaagtgagacccctatctctacaaaaaaatttaaaaattttgaaatgtggcatgttcctgtagacctagctactcaagaggctgaggtgggaggattgtgtaagctcaggagttcgaggctgtggtgagctatgattgtgccactgtatccatctagcctgggtgataaagtgaggtcctgtctcaaaaaaaaaaatttttttttgccctgtttttaaatatatcaagaaattgtaattctacccaagtaacctgaaacaagaccagtaatatataacactcttcagagttgagaaattcatccttctgtataaattaagtatttctcttaatttaaagccattttagatctgtctccttccattaaataaatatttgagtttttttttattattaaaaaacccttcatatacttgatgactgtcctcaggtcactcctaaacgttcccttttttcacactaaattttactcatgtcttatgaaatcctctgaacagttttcctgctttttctagtagtagaaatagaaatagctaacatttgttagacacttaacatgtgctagggactatgctaagttttttaattatatgatcctttttaatgctgataatcatgttgtgagatagagaagtattctcatcttacatgtgaggaaattgaggctcagatgagttaagtaacctgactgtagctagtaagtggcagagctgggatttgaatccagggtcagttgactcccaagccagaactcctaatcaccaggttacgctagactatcttttaagctacccactccaaaatcacttttaaagaaacataaggattacagcttagcagttttctaataaagatggaaatagtactgaatttaggacataatcagactcctattaatatgttctgttaaatagtaatatcttgttaatttttaggacaaaaaccctatacacatcctatgtaagaatattgtgattattaccctccagatactttttagcctctgaaaataaaaagaccatttccacatagtcttcactttgttatttactcagtaccactggagtacttagcattttaaagaaacagggtgtcttctgtctgggaggagtcttacctattgagatagttcagactgcttcctagagctggtaaggttaaaaaaatggaatgagtctaggaaatattaataggttagccataccagaataggtctttgagacccattccagttgagtaaggtgggatgattgcagggtcttccaacattagagaagaatttcaactcagataggaagggatggggaagggtaaaagcaggatttttcaggagacaggtgatatacaatagtcactgtggagaatgaagtataataatggcagcatatttgtctactctacatagatgtcctgcaggcatcttaaactcaacctgtcttaaaccagtattcattaccaccccgcccaccacgcccactccctgaaacctgattcttcttctgaatcctttaccatcaactcttccttcttccatatcagtcacgtcaattctatttgtgggatatctctgccttttcttctttctttctttctttctttttcttttttttttgagacggagtcttgctctgtcgcccaggctggagtacagtggcacgatctcggctcacttcaagctctgcctcctgggttcacaccattctcctgcctcagcctcccgagtagctgggactacaggcgcccaccaccgctcctggctaattttttgtatttttagtagagacgcggtttcaccgtgttagccaggatggtcttgatctcctgacctcatgatccgcccgccttggcctcccaaagtgctgggattacaggcgtgagccactgcgcccagcctgccttttctttcttaatgctaccctatgtccagtcttgctcctcccacccttccaacatactactggtagttacttgatctctgcttttaaaagctaatgccactccctaactggaaacctttcatgatttcttactgcatacaatataatgtccagaggcctcagcctgccattcagaagtcttgtcttaacccactttttccatccttatctcattctctctcctctaggttttccaagcatcctgtctctgtccccgctgcggtgcctgtactgatgttcacctctgcttgcggctcttttttcctcctagctgcctctcaaaagttctgtctgtttttgagatccagctcaaacttcacacttcatttctgtcatatagcataacacaatatgcgttgtatttgatacacatgtgcaagccttttttctccactgtattgttgactctgggagagtaagactgtattctctttgcccagcctagcatgatgtggggataatgcatagaaaactcttaatatggtgcttgatgtcttctttgtactcaatagtgttctaataaataagtgggtgctcattgttggtggactttgaagatggaaagggcttcagctggataatagtgtgaagccttaataacaggctaggtataaattgaacagggaagtcatggcgtagcacaaaattcctctcttttggttaattagtattttagtgttgtttacaacttgagcagtttgaaaagggaggagagtaatttagagggaaaaatgacgttggttattttttttccagagagtagagagctgtgtatgcctcaaacatgagagttttcatgtttcttcagccttcactccctcagtatggttttgtgtttgttgtttccttaggtattatatttgtcaaggccccatatagtatagagtttagaattcaactgtttatcaaatactttagtgcccactttctaccagcacaatgctaggtactttgaatgtaaacatgaataaatatggtttaaccttagaagtatttaaagaatggcacaggagagctgggaaagaggatcacaattaattatgagaagtcagaaggctccatagaaaacgagagttgaaatgtgttccaccaggagagtgatgctatggaagtcaaagacaaacaatttcaaggaggaagaagtggtcaaaaaatattaaataagtattaaatgccagtgctatttatagtagattgtgtgacttacttagcgttcagtaggggcaaaatggaatacccacattgtatagaatgctgccactttgctttctgcaatcacagaagctgaagattctggatgactattggtgctactaaatcgttagagcagaggtacctaaccaactctactaaatcagaaaaggggcaggggtgagggttgggttgcaggcacaatcttttgaaaaaggttcccagatgattttttttttttttttagactgagtctcactctgtcgccaggctggagtgcagttgtgtgatcttggctcactgcaacctccgtctccctggttcaagcgattctcctgcctcagcctcccgagtagctgggattacaggcacacgccaccacgcccagctaatttttgtatttttagtacagacggggttgggagtttcaccatgttggccaggatggtctcgatctcctgaccttgtgatccacccgcctcggcctcccaaagtgctgggattacaggcgtgagccaccgtgcctggcctcccaggtgatttttgatgaacaaccctggttatggaccattgccttgtgtcaggggttggcaaactttctgtaaaggaccagacaatatttaaggttttgtaagctatgtggtctcagttgaaatcacagacaatacacaaagaaatgagcatggctgtgttttaattaaactttttatttacaaaaagtttttttgtaaataaaacaaagtttgtaaatcccgtggattaggcccacaggatgccttctgtagggaggaaaagaggtaacttttcttcctgaagatttattcagtggcctcattgtcatctgtgtagctaagcgtacatgcattgtgaatgtattcatataaatgtgattttttttaaaagctccagttatggcatgcagattaattttaatgtatgcagatattttaccagtcatttatattaaaatgaactttacttttgaggtgataaaggagaatgaatgtaaggtcaaagagaaacttggaagtgtaatgatggaggaaattgggtctttggctattactgaatacatttttttaatgcataatttttttatttgcctccatttaatactttttggtaactgggaatactgtcaattaatttcattataaaatcctcatttatttttgctaatggaggagatccaaaaccaataatataaacaaaatgtattcttggtgttgggggctgtcttggtacttatttgagcataggtgtggatgaggtgttcttcacagactaaatatagcaagcggcatagcagtttagagtaccctcagctggaaaaacccatacacgagaaaagcttggacataaaaatctgagctcagaaaatgtctgtctgaatctttcagatacacaaaaagaaacttcagaaactccaataagataatttatattcctcatcaatcatgatgcagaaagtcagatagagttggagtatgtgatattctgagcaaggtcaggagatgaggttaaggcttagttcatttccctccaatttccaagacatctgaaataatctattcagtaactacttagatttagtctgttaaatctagtaaaaatttaatgagtacttttcagtggccctattttttagaagcacctggaatttaaggtcctaatctgtttttcaagcaacttgtcacttttcagtgactgacagctttcagatttcactgttttctggctttccatttaaaccttaaaagtagtgtttagtttgtgttcttatgagacctccttcaaaatgctgtatttttaaaaaatagtaactaaaggatcaaacagaaacagttatgagttcgtattccaccctcccatgaagtggcactttttaaggaatttttaacacataaatttaacaaataaaaactaaaacagcagttaaccagataattcagagccactctgttgtctagttatttggatatgtgaggtattactataaataaagcaatgaagctggagttaaggagcatttttggggcatctctgaaaacttgcccctaactgtactgtcactttctagtttttattggaggtagtattacctgttattaaaacaaaaagccaagcacctgcgtaaagtaagctgctttcactttgtttttggctcgtatctcctgtgcaaatatcctcagtacagcgttccctactccaagagcttttggcatttttttttctttgcctacaggctcaagaacgtgacctctttttgtacccttctttgccttgtctgtgcatttgtagcagttttctgggagcaggtttctttagaacagttaactgcttggctgtgagaatgtgtatctatacactgatagtcagttactgacagacatattagatataggacaatgaagctggacaaagctaagttgcagacagcctttcctccatcagttccctatggctctatctgaccattaggttccagcttttccccaagagccttgtcgtagaagttggcaatctcattttcattttactcccctatagttactgagaaagcaatatttttccttttgctctttaagacttctttttgcaaactgaatttcagtcctgtcctagttaagttgactgaggagcaggtatgccccagcctctggctcctacccgacattagctaagtctcagtccatttagttccttgtgtctcctctcatgcatgacttagttcctctttcatcagtgggtcagctccttgagactctgcttatgttgcacaatttaaccttaagttagtgtagcttctaacaatacgatagagacgccatgcaaatatctgtaataagacaggacctctttttccagtatccctaatttgaagctgttaattaattattaaggtttactaggtcgactaggtagcaaactgaataggggagtgagagaaaaattattattaatgaagaagttttcacctctatctaaatcaagaacttgaaatcaggatacaagcaggataagctgagaattaacatgtatgcctatgttggaggcaggaaattagccctcaacagaatatctgatacatggggcaggccttttttgcggggagttggggagaggtcttccattgtttttgaaaaacatgtttctgtcaggttaactttcattttcccacgtttgagggagccatggatactgtgcaagcatgatggtacatggcagctgacagtcattctgctgaaggcccagtagggactgtggtaaattggagagcaaatgttttgtgtaaagggagatactggagccattattagggtataaccaaccaggtgccttgtggtagaggggtccccattttccagttatttcacctttttctagggaaggcctctttgttttatttttatttcctataacattttttaagctggactagccacctatctggtttctcagcttctttaatttttctttttatctcatcttagttttcaaccttgtttctagcggggctaatcttttccctgaaacattcttgccacgttcattctgtgctcctccaactggattgatctccccaatttcaccattcccagtcctagatcagaatgtttaaatatttttagaagtagctgaagataattatgttaaatctgcaggtattagaaacatgaatgagaaaaaatatgccataagattaagatcttcaataatagagtatgtttgcaatgacatacttactgaacagtactttgtaaggcacagtgttactcttcaaaaaaaaattctgtctagaatgaattgattgataaaatttatgtatttataatcagccatataatggagtaaaatgataagagccaaaatgaacagtatatatcttgagtcccataggagtttagagaaaaaggattattttagaggttggaatatagcatggtagactaagataattttccctttttgtattcataggtaagcaagcaaatgtaaacattgtattttggctttattatggataatttttgctattttgttagtaccttgccagaaatttgactgcttgtatgtgaatgctgcataaaataggtcctgggaattctaatttagcaaaattccaactcctaaccttgtaaagaagtttccactccgaaaatattttttattggtatgtcttcctctttcttgtctttcttgagtgaaactgactataaaaataaagtaagctttaaaaaaattatctgtcctgagttgctgtagttaactggttatttgcaaaatgcatgtatttcaccatagcagcttaaaaccagttactttgggcagatttaaatttataaccagccaaaaactattttggtatattttgggtttttggttcccatcttattctcaccagactgagagacgggtattgaaagcatttactagagttttcctaatttgttttttaaataatatttttgcatataaaagtacttttgcccattgtagaaaaatcaaaatacagggcattatgaagaaaaccagccacccagagatagccacttagcattttgctgtttttacttgcacctgttttaaagaatctatgttataaacatagttgggttcataattcacatagttttgtatcctgcctcattttttttaacttaacattacacatagatcttcctgagccattccaatttctttgaaaagagtggctgtagaacattctctcatatgtgtatactataatttatttaaacatttttctttttctttttttcttttttttttcttttttttttttttgtgatggagtttcactctttttgcccaggctggagtgcaatggtacaatctcagctcaccgcaacctttacctcccaggttcaagtgattctcctgcctcagcctcccgagtagctgggattacaggcatgtgccaccacacctggctagttttgtatttttagttgagatggtgtttctccatgttggtcaggctggtcttgaactcctgacctcaggtgatgcgcccgtctcagcctcccaaagtgctgggattacaggcgtgagctgctgtacccggacctaaatatttttcaattgttgataggtggttttacattttagactgttctaaataattctacaatgaatgtgcttgtgcattaattgcttgagtgtgattattttttagactaggtttatagagtaaaattactggcttagagaatacaaattttttaaaaaccttgttgaataaggcaaattgcattctagagagtatgtaccaatttccagctgtatacaacagtgcccatcttaactgtatcttgtcaatgttgagctcaatatagtattttaaatggcacctctcttttcagttttgctcgctaattgaatttaatatatttttttcaaaatgtacccatctaaacctgttttggatgtaagtttcaagataaactactttccctaaagttcttagtgaagtgggataatgtttgatgcgttaaaaaaatagattgcaaaatagtatgtgtagaattacgtttcactaagcattgtaacactgtgaggcatctctgcttggtgagtatgagtgatttaaaatttttctttgtgcttttttgttttccagaatttctttaatataatagaactttgtaattaagctacagttcaaatgctgtacctccttaagaatttataagccatccaaaagctttgccttcttgataatttggcatagtatttctttttacagtaatactttgaagtttctgtatttatttaaggaagaaaggggtatttcttgtatcaataatgggcactggccctcatgttttctgggaaacagctgtagtgagactgtttctgtttctgacatatgaatattttttaaatgatagcctgaatgagagttttagtgtttgacttgcttagagaaatgtaagaaattttattggaatttatattagcctcttggtacaccaatattgcttagaggccgagtaatccaaaagttaggaatgctaagtgttctttatgttcaaattaataaaaagagggatgagaacactttagaacaaggtgtccagcaaccaagaagcaaatgaacagttttttagatttagcttgttgtgaatctattttggcatgtcatgtacagttaaatggcctcattataaaagttcacttggtacagtacattatgatatgttaatcaaaaccactgaaagtcattgttatgtaactttttaaagataacttttttcctaaatgtagagcatgagctagttaatcaatatgaattatccattaaattcaaaaggtaaggtataataaaatacattgaaagaatctgttcttttatctgtttgcctgaattcatagtgcaagaggtaagtgacatagattaaattgaaatactgtgcatattttcataatataatcaacttgacatcacaaaatagtctcagagctcaaggtattaaaaaaactacctaattctttcaccttgtctccttccctcgctttaaatggattttactaggttctcaaatagtaagttatgtgagatatttttcccacagagtctcattaattaagtggatttttttttttttttttagacggagtctcgctctgttgcccaggctggagtgcagtggcacgatcttggctcactgcagcccccacctcctgggttcaagcagttatgcttcagcctcccaagtagctgggattagaggcatgcgccaccacaccccagctaatttttttgtatttttagtagagatggggtttcaccatattggccaggctggtctcaaactcctgaccttgtgatctgcctgcctctgcctcccaaagtgctgggattacaggcatgagccaccgcacttagcaattaagtggaaattttaaggaaaactttttttttctggtatgagacattttctccagttacttgtacctaggaagatctggattacataaaaagtctcttttataatgttatatacagctcacattcctgaattacagtatttcaaattttctcttgaccataatgaaacaatagacattaataacattctgttaattttgtcagtgtttaacatgggaaaaaataccccagaagaattttattccggttattctaaggagagaaaacaagaaaagtagcattaattacaaaacttttcaataaccaatttgttttccttgacagaaattgatatgcctctaatctgatatacagccttagaaagtcacatactaataatattattttgtcgttttgctgtagatgtgttctttgtgccattgtcctggagcaacaattggttgtgatgtgaaaacatgtcacaggacataccactaccactgtgcattgcatgataaagctcaaatacgagagaaaccttcacaaggaatttacatgtaattatttaacttctctttaagttttttttttaacaataatactttctttgggcttttgtaaaaatttttcccatttcaaagcatttcatcatcatcataaagggtgtttttgataagaaatttaatacttagagaaatagtacaggaagtttaataatatattttgaatccagctagtgaattgggtgaagtgtactgctcgttttcttaatttgaaaagtgagtttaatttagtttgcttactaatttttgatttcttcattttttatagggtctattgccgaaaacacaagaaaactgcacataactccgaaggtacatcatttagccacgtttcagccacttttcagtttcaagaagaaatttgagtacagattagtgaattatactatattaattttaaccataagacatatctcaacattcagtacatttagaagaattgagaaaagtgttaggataaactaatgtgcatagtgaaaaagatctgaacttctttttttttttttttcctgaaacgaagtcttgctctgtcgcccaggctggagtacagtggtgtgatcacagcttactgcaacctctacctttcaggttcgagcaattttcctgcctcagcctcctgagtagctgggattacagacgtgcactgcaatgcccagctaatttttgtatttttaatagagatggggtttcactgtgttggccaggctggtcttgaactcttgacctcgtgatccacctgcctcagcctcccaaagtgctgggattacaggcgtgagccatcgtgcccgaccaagatctgaacttttaagaaaacttttaccccaaagtccttgtaaagtatatgctgaaaatctatctttagtaagaaattatgctggtggctgcgtgtttcatttctttgtgtttttttttttttgtgagacagagtctcgctgtgttgcccaggctggagtgcagtggcgtgatcttggctcactgcaagctccgcctcccgggttcacatcattctctgcctcagcctcccgagtagctgggactacaggtgcccgccaccacgcctggctaattttttgtatttttagtagagatggggtttcaccgtgttagccaggatggtcttgatctcttgacctcgtgatccgcctgccttggcctcccaaagtgctgggattacaggcgtgagccactgcgcccggcctcgtttcttttctgttttctttttcttttttttttttgagacggaatctcgctctgttgcccagagtgcagtggcacaatctcggctcactgcaacctctgcctcctgggttcaagcgattctcctgcctcggcctcctgagtagctgggattacaagcacccgccactacgcttggctaatttttgtatgtttagtagagacgggatttcaccatgttggccaggctggtctggaactcctgacctcaggtgatccactcacctcggcctcccaaagtgctgggattacaggcgtgagccactgtgctcggccagctgcgtgtttctttaaggatgataaatgggatccttgatactgtcatattataaatgatgtgagcttggtaatagtagtacattttgtgatcaccaggctttctgttatatttttattcacatctgtagtactttaaaaaatgccaatgtgttaataagtaaccaaatttaaaatacaaactttaaaaattatttaatagtttgtttctacttaaatttatataaaaccaggttagtcatgtttatatatagttagccaagttgaacttggtctgtaaaaagtatgcgaaaactctgatactgagttctgacttgtttcaaaccttttcaaacagatggttttgatacttttactagcaatataaaatggcttagatgtaatctgcgattgttctatcccttcatttagattagagatctttaaaatttttgttcgcttttgagaatatgttgcttagaattataatggtttgagcactgttgttttaggaagctgtttcttttatgaagatttacctaattattggtattcgcatgttaaaattggtggccctttttgatctctagatcttggcttttataatacaaaacaatatagtttccacttctggactcgagattagtccagatactttaaagtgttggttaaaaatacagtcgttagcaaaatctagtctttaaggtaaacatgctggataaataataatttttttgaggtgataaaatatgacggaaaaaaccttagtagtgcttttcttctgttttctcctcactgaattctagaattgaattggaaaatcctttgtgaaagattgagtacgcttttccaccttccattatttcagattttaacagtgcatttatttcattctctttaagactgtagtggccctatatggtttttttcttaatctatttttaatttttgtgagtacagagtaggtgtgtatttatggggtacatgagatattttgatacaggcacacaatgtgaaataagtacatcatggagaatggggtatccatccctatttcaaacaatccaagttaagctgaggattgagactatgttatgctgtatgttaagctgagaattgagactcatgatctgatgaatacaagtatgagcacactgagacaggatatttgagataattaagaaggatgattaatatatactgattatgtagatagctcccattttattccctggatttctgaagctgacagtaccatctagtggtagggagaagtcactgcaaactatataaagtagaataattttggccatgttttagcactgtgacacttaatagagatctaaattcatacttttcaagacaacttttcttttactgtaactggcagcattattataacttcagatttgtgctacaattaatttgaatttgggattcgatgtgtacgtctatagaacaatgggcggggggcttgtatcatttttatatatagtgtgtttatactcattgtggaccttgaaagaataattttataatttaaagtattaaagctttatatttattgatttctggcttttatcacattgatctagctcaaatttagttgattttgagtgctttgtcagaaacagaacttccaattattccattgttctaatgggaaacatatgttctcctttacgatcatggtttatgatgggaggttataggattgtatttcagggactgtcttttaagaattgtactgcactaaaaaaaaaaaaaaaagaattgtactgcactagtctccagaacaaagatgaattaatatctatggtaatgtcttggtcatttgccatctgtggctcaatacttactttgctaatacttaatatgataaatgctattaatatataattcattctgccatgttagctttatataaaatgagctgttttgaaatattaaatttgagaataattgcataatatagcaattcaattttcccatcacaaataaaatattattgaatattaaatacctaaaacctatgtcatcagttttgcttcaggaaaaaatggactgtgaatttgaaaagcaattttaaaaatctatatggagtttataactatcattatgtcactaggttattagaatgcccgtcccaggaactgtatgtatttacctgttagtggtgatgggcttagataagttgcctataaaatgattcgaaacatataagaaagcatttctgggctggcacggtggctcactcctgtaatcccagcactttgggaggccaaggctggtggatcacctgaggtcaggagttggagaccagcctggccaacatggtgaaaccccgtctctactaaaaatacaaaaattagctgggtatggtggcacacatctgtaatcccagctactcaggaggctgaagcgggagaattgcttgaacccaggaggcggaggttgcagtgaactgagattacgccatttgcactccagcctgggtgacagagcaagacttggtctccaaaataaaaagaaagcatttctgataaaaaaaatatctcccctatcaatggtgacagttaactgaggacagagtccttccggaattatatacaagctagtaaatatatttcagctactattttccaggcctgttaggtaattggagatatagggataaattagatgggtctctgccccaaagagcttgaagtctaatatgagagatgtacattaaataaatagttgcacaattaataggttacaattgtaataaatgccatgaatgagaaattagagtgccatgagcaaatgtttggggggacctatgaggaaatttcatttaaattaagtcttaaaagactaaagaggattggaggcacattctatgcagaaggaacaggatctttgaagacttagacaggaaggaacttgatgcttccaaggaattgatagaaagctatgtaagtaaaagatagatagaggcaggcatggtggttcatgcctgtaatcccagcattttgggaggctccagtgaggagatggcttgaggccaggagtttaagaccagcctggacaacatagcgagaccctctctctacaaaaattttaaaaattagctgagtatggtgtgcacctgtagtcccagctactcgggaggctgaggcaggaggattacttgagcccagaatttcaaggctgcagggagctacaatcatgccactgcactccagcctaggcaacagagtgagaccctgtctcttattcaaacaaacaaaaatgataggtagagtggcatatgaggttgggagaagaatacatgggccacaatggtagggattttgaatattatcctaagaacagcaagaggtaattgagggttttaagcaaagagaatggcttgttgcaggaatcctggttagtagtgatagaaggcttggactagagttgtaactacggagatgagcagaagtagacaaatttgagagagtgtttgaagatagaattgatgggacttagtaggtgcatccaatatagggataagggaaaagagatattggagatgactccaaggtttctggcgtatccaaatgggtgacggagggtgccacttgcttagataacaggagaggtaaagtaagcttatggggaaagttgatgagttaagtttgaaagatcaagtttgaggtacctatgagctagctaagtggggatatcagagaagcagatggattgattatatggttcttgttctcagaatagagatcttggctagagatagaaatttgccaagtgtgagtatagataattgcatccttgtgagtggaggaaaaatcccctaaggagagcgttcagaagaggaaagggcctaggactgagccttgaggaactttaacaattaaaggcttggtatagaaggatgggcctgcaaagggagagaaaaagaatggctagagaggtaggaggaaagtcagattagtgttacatcctggaaaccaaaggaaggaagagagtagttcctgaaggaaccaaatggtcaacttcgtgggctgttgaaaaagtatccattggattcagtgacaacggagccatgggtgaccttagaaaatagattgggtagagtaataggggtaaaagccgtattgatatgcacctcgataaatgggaagtgagaaattggagatttgtggcatggcatgttacatacatgtcaaaatccatagaatgtaccacactaagagtaccctaatgtaaactgtggacttcaggtgataataatatgcctatatttgttcatccattgtaacaaatgtaccactctggtgtaggatgttaatagtaacacgggtaagcctcctaatatgtttgcttgtaaaggggcagggaatagttagaaggaagttaaagggtggcttttttcccttaattaatagactttatttttagaacagttttaggtttatagcaaaattgagcacaaagtacagagttcctgtatatctcctgttccccaacccctaacatacacacacacacacacagacacacacacacacagacacacacacacacacacacacagcctatccactattaacatcccacaccagagtggtacgcttattacaatggatgaagcaatattggcacatcattatcacccaaagtccatagtttaaattagtgcactcttggtgtggtacatgctatgggttttgacatgtgtataatgacacgtacctaccattacagtatcatacagaatcatttcactgccctgaaaatcccctgtgctccaccttttccctcccaaacctctggcaaccactgatactgataccactgatacttttactgtctccatagctttgccttttccagaatgtcgtagttggaatcatacagtatatagcttttttcagattggtctctttcacttaattgccttttatttttatttattattttgagacagggtctcactctatcacgcaggctggaatccagtggctcaatcacggcttactgcagcctcaacctcccaggctcaagtgatcctcccacttcagcctcctgagtagctagaaccacaggcatgtgccaccacacccggctaattttttttacattttttatttgtagaaacggggtcttgccacattggccaggctggtctcgaactcctgggttcaagtagtcctccacctcagcctctcaaagtactgggattacaagcgttgagccaccctcccagcctttgccttttttttttttttttttttttttaggaggagaattaattgatacatagaccccttaagagaagggatgctatgggcaggaagagattgaaggtaaaggaaaaaggattcagcacccaagcaaaacaattggcctgtgatagaagggcatttccactgtaataagagggaacgaagaggataagtggctcctttctggtctgccttctctgtgaaggagaatgtagcaaaaggtgtgagggttggaagctgaaggaaagagaaccgtttgaaagaatagctctgaagactgggagaggaagtttgcctggagaaatgtaaggtttccagaataggttgagggccctgttgaggttagtacccatgagtttatgtagtggttcccaacagtcaagtgatgtgacttttccaccagtaattcaggatcctgtatgtgcatagagaaagtggctagttgggtaaataaaaattgggatcttgccaagtgagtttaacgaagtaaagggatatgggagtttaggatatttgcaagagagcagtttgagcaagatagggagggaagtgacagcaggagaacaagaaacaagaaagcatcagtggactggaggtcctaatagggttgaagaacaatgagaatgaaagtacttaggaaaacaagcatttgtggtcccagagtgtgacatagggatgtcagaaatagaaccattttatgtgattataaggtttttgagtgtggtaaattggagagagtaatgcccaacttaccagtacaccaacgctcctcctagtattctaaagccctgtctgtcccttttctgattgtcttctcttcttaaccactgttttcctcatcttacatcttcctagtttatgctccatcttcctcctcctaagttctcacatcatttaacagtgtgaagtagaaagggtatctggacagaaagtctgaaactgccacccactaggtcttaacttggttaacttattcacaaggcaaagtgtcctcatgtatcaaatgagactaataaatatataatttttgtttagggggagtgggggaggacataattaagtgacagatatgtgacaaacattaaaatacagtggtgacatcatggctgcatcttactcttaaacctttcaggaaaaaatgtgtatggatattgagagagaatgaatgataaagcaagtgtggtaaaatattatttttagaatctgggtgaagggtatacaggaatttttatgacaactttttttataagtctgaaattacttaaaaagataaagtggtgataagtgttagaattacagtgaccacaaaatcccatgctttctgagatggtgtaaaggaatcttttgtgcctaaccttggaggctatagtctgtattttattcaaggacctggtggattccctaatgaacagttctgaaactttatattagaaattgcttgtcaaatgatataactcagtttatgtttcaggaaatagggtcaccatagttatattaaaagtatcttaaaaatgttataatttatgtagatttgaagcctttacctgctttaatattcacttattggttgttttttgtttgtttgtttgtttgtttgtttgtttttttggttgagacagagtctcattctgttgcccgggctggagtgcagtggcacgatctcagctcactgcaacctctgcctccctggttcaagtgattttcctgcctcagcctcccgagtagctgggattacaggcaagcgccaccacgcccagctaatttttgtgtttttagtagagacaacatttcaccatgttggccaagatggtctccatctcctgacctcgtgatccgcccaccttggcctcccaaagtgctgggattacaggcgtgagccaccgcacctggccacagtttgcattacttttattaaatggaaatatagggagattctgatgttggtattaagctctttaaaaacctttaagttgagtagcattgaatagacttatgaagtactgggaaggcagtattatacactggttaagagtatgggctttgaaataaggtctgtatttgaatcttagctctgccacatcctaggcacatgatctgggacaaattatttgatcgctctcagaggagagccttagatattgcatctgtaaaatttgggggatttttttaaaaacctacctcataggattattctaaggattaaatgaaaaataatgcgtgtacaactctaaacaatggctcagtacaggcataccttattttattgcacttcagtttattgtgcttcacagataactgcattttttacaaattgaaggtttgtggcaaccttgcattgagcaagtctttcagcatcattttttccgacaggatatgctcactttgtttctgtcacattttggcaatctcacaatatttcaaaccttttcatttttttatccgttatggtgatctgtgatcaatgatctttgatattactattgcaaattgtttagggacatcatgaaccgtgcccatgtaagacagtgaacttaattgataaatgtggtgtgtgttctggctgcttccccaaccagccattctccatctctctccctctttttgggcttccctattgtctaagacataacagtattgaaattagaccaattaataaccctctaatggcctcttaagtgtttaagtaaaaggaagagttgtacctttctcactttaaatccaaagctgaaattattaagcttagtgaggaaggcatgtcgaaagctgagacaggccaaaagctaggcctcttgtaccaaacagccaagttgtgaatgcaaaagaaaagttcttggaggaagttaaaagtgctattccagggaacacacaaatgataagaaagtgaaacagccctattgctgatatggggaaagttttagtagtctggatagaagatcaaaccagccacaacattcccttaagccaaagcctaatccagagcaagcctctaattcttcaattctatgaaggctgagagaggtgaggaatctacagaagaaaagtttgaagctagcagaggttggttcattagatttaaggaaagaagtctccataacaataaaggtgcaaggtgaaagcagcaagtgctgatgtagaaactatactgagttatacagaggatctagctaagatcattgatgaagttgcctacacaaaacaacagatttttaatattaatgaaacagccttgtattggaaggagatgccatttaggacattcatagctagagagatgtcaatgcctggcctcaaagcttcaaaagacagtctgagtcttgttaggggctaatgcagctggtgattttaaaaccaatcctcatttaccattttaaaaatcctagggcccttaagaattacaataaatctactctgtttatactctataaatgaatgatagcacatctgtttatagcatggtttactgaatattttaagcccactcttgacacctactgctcagagaaaaagattcctttcaaaatattactgcttattgacaatgcatctggtcacccaagagctctgatggagatctacaaggagatgaatgttgtcttcatgcatgctagtacagcattcattccgcagttcttagagcccgtggatcaaggagtactttggactttcaagtcttattatttaagaaatacatttcatgaggctgtagctgccatacatagtgatttctgtgatgaatctgggcaaggtaattaaaaaccttctggaacggattcataattctggatgccattgagaacatctgtgattcaagggcagaggtcaacatatcgatgttaacgggaatttggaagaagtttattccaaccctcacggattactttgagaggttcaagacttcggtggaggaagtcactgcagatgtggtagaaatagcaagagaactagaattagaagtggagcctgaagatgggactagattgctgcaatctcatgatcaaactttaacagatgaggagttgcttcttatggatgaacaaagaaagtagtttcttgagatagagtgtacttctggtgaagatgctgtgaacattgttgaaacgacaacaaaggatttagaatattccgtaaacatggttgataaagcagtggcagggtttgagaggattcattctaattttgaaagaagttttcctgtgggtaaaatgctatcaaacggcatctcattctatagagaaatctttcacaaaagaaagagtccatcaatgcggcaaacttcagtgttgtcttaatttaagaaattgtcatgccaccccatccttcagccatccaccaccttgatcagttagcagccaacagcatcaaggcaagacccttcaccagcgaaaagattacagcttactggaaagcccagatgattgttagcattttttagcaataaagtatttttaatgaaggtacataccctttttttatacataatgctattatacacttagtagactacaatatagtgtaaacataacttttaaatgcactgggaaatgaaaagattcatgtgatttgctttattgcgataacttgctttactgtggtagtccggaaccaaacccacgatatcttgaagatgtctgtaaatactgtgttctatatcattattattcctttaaacttccacctgcttttatcaccatcttttcatgtgctcttccttagatgacaatggaatttaaattctttgtactttaacctggaaaattttagtagtgtattcatattgtggtcttcgcaccatgtaaaactgactccatattctttttttgtttgtttgtctcattctgtcgcccagactggagtgcagtggtgcgatctcggctcactgcagcctccacctcccgggttcaagcgatcctcccacctcagccaagtagctgggattacaggtgcctgccaccacgcccagataatttttgtatttttagtagagacagggttttgccacgttggccaggctggtctcaaactcctgacctcaggtgatctacccacctcagcctctcaaagtactgggattacaggcgtgagccaccgcgcccggccgactccatattctttctgattcacccatgtgcagagtactgtgttaggcattgtgtatgctcatctgtgatttagcacactgtacaagctttcattataggaaatttcaaacttaggcaaaagtagaaataacagcataacgtttcatctttaccccccactcactttcttcatttggattatttcgaagtaatcccagacatcagatttcattttagcacactttagtaataatatattttgggtgtatgttacaaatttgtatattcatgtgtatgtatatatgcatgtttgtgcatgtgtatgtatatatatataatatcaagtatatcaagtaaatgatttatatatataaatgatttatatatatataaatcatacctttcctgaaaaagcaggaagctgagttcacaaatgactccgcacatacagagtaaatgcacatcacatttacactggaaaaggcagggcgaatgtcctccagttttccttttgcagcaaccatgaagattcaaagcagaggtggtgatgcttgcctcaatcttaatgcctgtcctttttctttttctttctttctttctttctttctttctttctttctttctttctttctttttttttttactctgacaaacatttattgagtacctacaaggtgtgagcaccttggagaattaaagtccccatgtggacaaagagcttagagtctacacaagatatgccaagagtattaactaacaattaaatagaattttatagtttacaaagcatttttcacaagtaatttcttaaagcagccttgtaagaaaggtattaacattagtcccatttgacacatgaagacacttgtgaatggtaagtaacttaaccaagttaagacctagtaagtggcaatttcagatgttctgtccagatatcctttctacttcacactgttaactgatgtgagaacttaggaggaggaaggtggagcataaaccaggaagttgtaagatgaggaaaacattggttactaagagaagagaatcaggaaagggacagacagggctttacaatactaggaagagagttggtgtcctggtacgttgggcattcccctccctatagaggccataccagaggagaacagaagggtaatagagaggggcctggccattctaacgtgacacagacatctgcaagctgtgctgataagaggctgggaatgtttggtggctcgggaaggaggacaaccctattttgtcgcctgccttatcagcctggatttttagaaattgcagctgtgaatataagtgtaaagttttactttttatcgtatttattttgaatagatacatgaacattgtacaaaaatcaggctttcctgtcacccgtgcccttgtatctgtttctgaattcttttgctaaaagcaaacactactatctgtgagtttcttgtgtatccttccagaccaattatgtgcatacataagcataactgttctttttctaacatccaggagcatatggaaatgtgtatttccatgacaatgaatattactattttaagagcatacttgtagttattcactgacatatatatttgtcccagctctgccattctctagctttgtgaccttgggcaaaattacttaacctttctaaacttccttatctgtaaaacagggtggtggtgggtggagggggtgttgggaagatgaccgttacaactttgtggaatgattgtgaggctcaaatgagataatgcatataaaccacatagcatatctggtatagtgaaaacttaaaagctcaaatgttagctcttactattctatttccaacttatacacacatatttacaaatgaaagctgttaagatactgtacaagtgagcaaagataaatggagaaagtgttcatcacatttgtaacagcaaaaccactgaaaacttacaagtcataaccatagggggctggttaaatacgatggattactattagctcttatatggaaggaggtaaattcctatatactgacatggaaagttgtcaagctatattaagtggaaaaagcaagatgcagaatagtgtgcttagaatgccatttgtgtgtatatcattttaaaaaacgtgcatatgcagagaaaataatagcatttattgaaagcatcttatgtgccaggcactgttttaagtattttacatgcactaattcatgtaattcatttaagaaccccctgacgtaggtttcaggtccaaagatacacagtatgtggaagatccaagattcaaactgaggctcttatacactgaggttgagaaaagaagcagttaacagtgcttttctgggtgggaggtcaggaggtcagggagggaggcaggttagggagactgaggagccaaccaggagcacagagcaggtggaagtagaaggtgaaaggaagattttcactttttttacatttttattttgagactcgctctgtctcccaggctggagtgctgtggcgtgatctcggctcactgtaacctccgcctcccgggttcaagtgattctcctgcctcaccctcccaagtagctgggattgcaggcatgtaccaccacacccggctaatttttgtatttttagtagagacggggtttcaccatgttggtcaggctggtcttgaactcctgacctcaaacaatccacccgccttggcctcccaaagtgctgggattacaggcgtgagccactgcgtccaggcctaaggatttatctattaataaaattggttatatctgcttcttcatcattacaaataatactgcaacaatttcccttgtacataatatacttatgtacttatacgagtgactctgtaagataaaagtcttagaaatggggttgccaagtcaaagggtctatgcatttaacacagggaatgagtactgtcacgtggcttctgaaactgtttacccagtttatgttcccactaacagtgtctaattcccatacctgtgctaggtattatgtctttaatttttgtctgattatttcatttaattttaatttccattatcactggtgaggttgggcctctgttcatgtttttttgtcatttatgtttcttttgtgaattgccttttcctatgctttgtgcatttttctcttggggtttgtctttttaaaattgatatacaggtgttctctataatatagatattctgccactatatgcaaatgatcttccaatttatttatttatttgaaacagagtttcactcttgtcaccaggttggagtgcagaggtgcgatcttggctcactgcaacctccacctcccaagttcaagcgattttcctgcctcagcctccctagtaactgggattacaggtgccctgccaccatgcccggctaatttttgtatttttggtagagacggggttttgccatgttggccaggctggcctcgaactcctgacttcaggtgatctgcccacctcagcctcccaaagtgctgggattacaggcctgagctaccgcaccggccccaatttatttcttttaacttagtttatggtgcctttagctgtacaaaagttactaatttttagtcaaatatcccagtcttttcctttagggcttcttatatgtcctgatccaagattattttttaaaattctccgctattttctcctattatattcatagtttactttacaattagatttttaatacatctcctaactttttcatatagtatgaggtatccatttttaaaaaatggatatccagttgtgccattatgtcttttccactcatctgaaatgccaccattatcatattttcaattttcatgtgcacgtgggtctgttttcaaacttggagattctcttccactgatatatgtctattcttgtgccagtggtttaactgctattgctttatagtatattttgatatcttcttttcaaaaggatactcttgtgtattctttttttcatcttgtgtattctcatccattttccagaaaaccacagaatcaactttaagtttcatttcattaagtcagattagtgagagctgattttctgtgtatcatgttcattcagaaacatagtctatctctccatttaggggcacttgttttatattttctttctaacacgtattttgttgggtttattgtaccttttttttttttaacttcagattcaggggggtgcacgtgcaggtttgttacctgagtatacgatatgatactgaggttggagtatgaatgatgccattacccaggtactgggcataatacccaatagttagtttttcaacccttgcccttctccctctctcctccctctagtagtccccagtttctattactgccatctccatgttcatgagaacccagtgtttagctcccacttataagtgagagcatgttgcatttggttttctgttcctgccatatccttattgccacaaaggacatgatttcattcttttttatggctacaggatattccatgtagcagggtattccacaccaaaccacattttctttatccagtccaccgttgacgcacacctagggtgattccttgtctttgctataatgaatagtgctgcggtgaacataacagtgcatgtgtctttttggtggaacgatttgtttccttttgaatatatacccagtaatggtattgctgggtcaaatagtagttccgttttatgttgtttgagaaatttccaaactgctttccacagtggctgagctaatttacattcccaccaacagtgtataaacattcccttttctccacagcctcactagcatctattgttttttgactctttaataatagccattctgactgatgtgagatggtatctcattgtggtttttattttagcttttaataactatttaaagtctgctgttttgataggtgaaaatgatatatcacttaatttgcactttgatgctggagaagttaaatatttttaaactatacttattaactacttatattctgagaattatctgattatatccttgatctgtttttccatttgggtcttaatcttgcatgagcttatcatatcataatgatactaattccttgtcagaggtacagcagaagcagatatttttccagtttattttattttattttattttattttattttattttatttttgagacagagtcttgctctgtcacccaggctggagtacagtggcatgatctcggcttactgcaacctctgcctcccgagttcaagtgattctcctgcctcagcctccctagtagctgggttaacaggcacgcgacaccatacccagctaattttttttgaagttttagtagagacaggttttcaccttgttggccaggctggtctcgaactcgtgacctcaagtgatccaactgcctcagccactgcgcccggcctttttccagtttattgtttgccttttaacttaccactttttttttttttttgagatggagtcttgctctgtcacccaggctggagtgcagtggcgcgatctgggcttactgcaagctccgcctcctgggttcacaccattctcctgcctcagcctcccgagtagctgggattacaggcatgcaccaccacgcccagctagttttgtatttttagtggagatggggtttttccatgttagtcaggttggtctcgaattcccgacctcaggtgatctgcccatgttggcctcccaaagtactgggattacaggtgtgagccaccacacccagcccaaatttaccactttttaatttatacttttcagtttgaaagtctaatatagttaaatatatgaatctttcgtgacttttactattgatgttaaagttgttaaaaatttttgtggaatgatttcatatttagaacaaatatgacatgtgggaaactaatcatgttggcttgataatggaatcagttcttaagtaatttttatagatgtttaataaataacattattaaatgttatagatgtttaataatgttatttattaaacatcttatttgtttattgttatttattaaacaactattaaatgttatttaatagtgttatgtatggtgttagtgatgcttattttcataatagataactgaatatattatgtgtatacatatgtataaaacaatgttttatatatacatacacatagatgtcttagaatgattgaaacagttatgatttttcattttgagaatttttaatatttggcaagtgcaagtaattcttttttgagatggaatcttgctctgtcacccaggctggagtgcagtggcacaatctcggctctctgcaacctccgcctcccgggttcaagcaattcttctgcctcagcctcccgattagctgggactacaggtgtgcgccaccacacccggctaattttttgtatttttagtagagacggggtttcaccatattggccagactggtctcgaactcctgacctcgtgatctgttcacctcggcctcccaaagtgctgggattacaggcgtgagccaccacgcccagccaagtgcaagtaattctaacagcttttagtgaaattccatgtcttaaaaattgtcagtttgaatatttaaattaagtagtgtattctgacatgaagtttgctatcgtgttaaggagagaaaacatctttaattgacttctgtgtcttcacaggaagttattcacgtgaatttattttgttgcctataaaacactatgcaataacttttaccttttccccttaactccctcaagtcccaccagagctatgtgaagttgcactcatgtaaattgttattaactgttttgcaaacaacctaatacttgtagttcccttaatttatatatatattcaagtataccaactgaattgcccttttcttataataaatgtgctttcatttctaataaacaaccttcaaagtagtaggaaagatattaacgtctgagcataggagttgatatgctttctcattgagaaattagtctctagaattataatcaataacatggtaaaggaaaaaatggcgaaaatattagagctgtgcctaaaactttccatagtttgagcctatggcaagtgaacatttggtttttattacccttttaaacactaaatattaatacattatcttatacagaggccttcaataaataaaatatttatagtaaactactgatgaaacacctttcattatggtagaaattcttttcagattactgagaaatgcagttctcaaatttctgcgtaagttttgcttaattcattaaagcatatgcaactaacttgcaacatactttttttactgcttgtattagaaattctttttgtacttaatatttgtttaattacttgatccattagttcaattgtaaatgacttccttgttgaatttgttcattcagttttcatgatcgtttgaagagtaatctagaccagtgttatccagtagaactttcctgtgacagtggcaacagtcctgtatatgtgctgtctaatacagttgcaactagccacatgtagccaataagctcttgcagtgcggtcagtgtgactaagaaactgaagttttaattttatttaattataactgacttaaattttttaaggccacatgttgctagtggctactacattgaatagcacagatatatctactttattttcatttagttttccaagttacagtaagtgtattttctaggtaagtgttctaattttacaaactctttgaaacctatggtaaaaaaaaataataatgcaaaagcaaactctaaaaattaatttactaaactatttgtatttgatttttattgcatttatctgaaacattgggtggctttattgaacataccacagaccatttctcctcatttctggagacagtttcattctaaggagaaacatatgtcctaaagacccatgaactaatacttattttgagattggtccataaaaagtttttgttcatttttaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatgtaagtaaaaaaaactgttggattcttacttttgttgcaccatgaatatttcatttaaactatctataggtaaagttcatcatttgaaatgttaagtaagcttgaaataccgatagcatattttcatgattttttttaagttcgttttttcttttacatttgcagagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatggtaagcatggttcttttaagcccaattttgtttttttgttgtttgtttttctttgtttcccctgtgatctaaagcccaaatgattttttttttaaaaatcatttagctagtaaccaaaaaatttccccccaccagcattagtattttagagttataaacagtatatcttataatcccaaatcttaagtttagattttgttaaattatagcctttatgttttagtaggatttgaagtaattctaattatagttactgtagttaggataatctgtaattaattatttcataactataaaaattttgtctttataagcatgtcatgaaatatattttagactttcactataacctaataattatctctgttgtacttaacactctatattacaattattcatttatgaacttatcttccctaacagactcttaaattccttgaagataagaataagtttttatcttgacatccttaggtccatgcctgacttacagtacacataaatatctttgacttagattgtattgaatgactcatcccattgataaggtttttaaaattacattatttatgtcagagattcttaaccagagtgcatgtcagatttacctggtgagctttttccgaaatatgtgcatctaggcaccctgtggaatagatctcgtatatgtctagtttgaaaaaaaaaaatacgcgagtgattctaatctgcatctatggttgaaatttgccaatttaaactattttttaaaactttgtggaaatgtaaaatagttgagaatagagtgacattgttgaaattttcattgcttaaagcaggctatttaatcttggctccacactggcagtcctcattttatttcaatgtccataattttggttatattttaatcagacatgtaaatatattaaaaatatttgagcagatacttgattattaaggaaagattatctttcttcggaaattaaatataacacacttgttatcacatttaatgtttctctcataaggattctgaatgttaattttcctgcatttttcttctctagttgttttcttctggcacagtccagctcacaacaacatcaagagcagaatttggagactttgatattaaaactgtacttcaggagattaaacgaggaaaaagaatggtctgtagtttttatatttgttatgcaacattacacttgatttgctgctttaaatttagagtacatcccaaatttatccagtcatcagaaaatttaaagtagttcgtatgttaaagcaaagtatatatttgacttatttgtaatataataaaggatgctgatgttactgaaacttatttctctatgtaacttcattactttaagagaattatactgagaagatttatatacatttcaaggcatttgcaagccgtttaataaaataaatgaagatatgaatgtgacaaacttcattaagtttaaaatgttacattgtgtaagcttgcttaaaggaaatttttttcagggctttctgtttaaagaacacatacacagggctgcctcttaaaatgtttgtcatagctttaaggttttttaaataaaataatataaaatacgccttagtctcatgttgttaaacatactgaattaccaacaagtagctctaagaaatgttggcatctttattgatcgcttactcctttaacacttatgaatgctatgtcggttatttctagaaattaatttttaaatttttttgttgggaaaattttcaaacataccgcaattggaaagcctagtaacatgtatctatccatcatcttgcttcatcagttacctaaatttgtggcgcttgtttcatataggccttttattcttgttgcttgaagtattttaaagcagacctcagacttcgtatcactatacctccatgtagttgagtatgtatctcttaataattggacattttcttacctaaccacaatgtcattataccttacaatttttttgtttattttttatttttttatttttttgagacagagtctcactctgtcgcccaggctggggtgcagtggtgcgatctcggctcactgtaacctctgcctcccgggttcaagtgattcccgtgcctcagtttccaaagtagctgggattacagacatgcaccaacacgcctggataatttttgtatttttagtagagacagggtttcattatgttggccaggcttgtcatgaactcctgacctcatgtgatccacccacctcggcttcccaaagtgctgggattacaggcgtgagcacccggctaaaaatgaaactttcgtaacagagcctgtagtactgaaaaaaggaaaaaccacttcatcatattattcagagcagtgttgtataatacagctaaagtccaaacaggtgactaagataacaattcaattatcttgccaacttattgtttacctctgtaccattgaggattggggtaaacactaacctagcatttcccccaagtgtgctccaaaggaagttagtccatcaagatgttcccccacccctccagagataaaagggcatctagatttcaataaacttgaaaactgtttactctgtgccccctcccttggagaaaaggctgtgagaagtcctgcaataaagtgatctgcttaacctatcctttctcaaacttatttgacttgaaacccccttttcaacaggtaccttttaatctccgaacattcttcaggcaaggtttatctaggccaaactgagaagttttgaaaagatttcagcccctttagtctccctctgtacttttgtctactggtagcaattcctctgtgggaggattgcttttctggtttcttattctttcccctaatcataataggaaaggatctgatcttagggaagaaaagaagccaaccactaagatatacaacatcattctttttgtgtatttggcagcattgaggagaatcttatctacatttagatgtcagacctgggatggtcagtagtttttctaataagccagcagtttataaatgttaaataagggaaacatcaggggatgacaatattagagggcttatcaaagtatggtttaagttgcagcattatttcagttatatgctatgtgataatttcagtgtactctttttcaatagaaaatagctgctgttttcttgaaatacggcttacgattatttctctttccttatacagaaatgtacactttgcagtcagcctggtgctactattggatgtgaaataaaagcctgtgttaagacttaccattaccactgtggagtacaagacaaagctaaatacattgaaaatatgtcacgaggaatttacaagtaagaaaacaacagttgtctatttccctaaacatgttagtaaccgtccttaaatagatgacattagtttactcagtctctgttcttaaatggtgtttagttaagtatagaatactgagcacattatgtaaggaatgagtactacaattggcattttcctctgactacatatccctggattagcattcatccatccaatattagttaggcttcctatgtgccagccattgtgcttgaagctgggcatatgccagtgatcaaaactacatacactgggccgggtgcggtggctcacatctgtaatcccagcactttgggaggccgaggcgggtgaatcacctgaggtcagaagttcgagaccagcctgaccaacatggtgaaaccccgtctctactaaaatacaaaaattacccaggtgtggtggcaggcacctgtaatcccagctactcgggaggctgaggcaggagaatcgcttgaacccaggaggcagaggttgcagtgagccaagattgcgccattgcactccagcctgagcaacaagagtgaaattccatctcaaacaaacaaaaaaaaaacactacatatactctcctcatgaagcttacagtctattgggagagacctattatttaagtggccaaatatgcaattacaacatagcagcgtaagtgttctaaagaagttacaaagtgttatgagagcgtataagaaggaagagctaacctagtctgtagtggggagtatttaaaatgttctgaaggaaatagtgctcagctttaagctgagatattaaggacaaaggtgagccttggttgggggaggtattctgggcagagagaagagcatatgcaagagccccgggtgagacagaagcagaggtggaaatggggagatgtgttaggaggctagtgctggtggtccaggtgagaattattggtagcttagaataggatatggtagacagaaggcaaaagattctcttgagaagatggtgaaaaagtaaagtatgaagatttgggattgggggtcaccctcttttttatgggtcttccacttacctgtgctgccttgtgctaggtggtgttaatgtatatctgtaatggttccatttgtttaatcgactggagtataagttggtagggactcttgaagttttgatttgccatccagagttgtaaagcacttccttactctcacatgcctagaatgcaataaaccaatgacttccgggtctagtattctgtgtaaaagacaatgtacacaagcagtcaccaagtcatttgggtgcctacataaggcgctatgctgtataataaaatttgccaaattctgtttaataataaaggcacaaatgttttcaagtgagttctataaagcctttaaggaacaaataatcccaatgttatttaagaggtccagcacatagcaagagatggaaaacttattgattcattctgtaaagcttacataactgtggtaccaaacctaacaaagatacgttaaaagaaaaacaaacaaactgtagaccaatctccccttttttttttttttttactttgagacaggatctgactctgttgtccaggctggagtgcagtagtgtgatcatgactcactgcagccttgaccttctgccctcacgtgatcctcccaactcagcctcccgagtagctgggactataggcgcatgccatcatgcccagctaattttttttgttttgttttttgaggaggaggaagggttttgttttgttgcccagactggtctcaaactcctgggctcaagcgttctccctgcctcagtcttctaaagtgctaggattacaggcatgagccatgcccagccacaatctcacttttataaatatacaaaaattctaaataaaatattagtaaatcaaatccagctctgtattctaagaattgaaagactgttcaggctgggcacagtggctcacacttataatctcaacactttgggaggcttaggtgggaggattgcttgaggccaggagttccagatcagtgtgggcaacaaagcgagactctcatctctatataattttaaaaatagaaagaaaaaagactgttcaaaattaggaaatatattaatataatttattagaattagtagagtaaataatcttatcaccttccttatagatggtgaaaagacatttgataacattcaacatcaatttctgaattttaaagtaacgagtgctcttggtaagctaggaatcttaataggtgtttatgagaaaaacaacagcaaataacttatttattattaaagtgaaggagcaatggttcttaaccaggagtgagcctcagaatcactgtggggtggataaggccctcttttaaaatgttcatgtctaagccctacctgtagagatttaaatttagtaggtctgggttggtgcccaaaccatgcacttttctgactccccaggtgattcttatgttcccctctaattgagaaccattagactatactttaattcagattaggaagaagacaaggatgccaactactagcatgacttttaacattcttctagagggttaagctgatgcaagacaaaaagaaagaggcccagtgcattgactcacgtctataatcccacacttgggaggccaaagcgagaggattgcttgaggccaggaattcgagaccaacctgggcaacatagtgagaccccatctctacacaacatttaaaaattagccaggcaaagtggcacacgcctgtagccccagctatacaggaggcccagactggaggattgcctgagccctggaggtagagaccagcctgggcaacatagtgagaccctgtctcaatttaaaaaataaaagaaggccgggcgcagtggctcacgcctgtaatctcaacactttgggaggccgaggctggcagatcacgaggtcaggagtttgagaccagcttcgagatcgccccactgcactccagcctgggcgacagagcgaaactctgtctcaaaaaaaaaaaaaaaagaaataaataaataaaagtgtataataaaatgatcaatatttgttattcatatcattgtctaccaagaaaattcaaaggaatcaactttgaatttattaaaattagtaagagctcagtaagattgctgaatatgagatgacttttaaaaaacaattccagtaataactagttagaaaatgtaaaggaaaaccgcctgccataccccgccaaacacacatacactaaagatgaattttttccatttaaaaaaaaaacacacaaagctttgttttggggtgtggttggggagacagggtctcactctgtcacccaggctggagtgcagtggcatgatcacggctcactgcagccttgacctcctgggctcaggtgatcttcccacttcagcttcccaagtagctgggactacaggcacacgtgaccatgcctggctaatttttgctattttttgtagagacaagatttcaccttgttgtccaggctggtctcaaactcctggacacaagtgatccacccacctgagcctcccaaagtgctgggattacagctgtgagccaccatgcctggccaaaaattacattttacaaaggactgaaatgagtggtgaaatatattatgttccttgatagaaaactcagcatcaaaagacacctattctcaccaaatgtataaatttagtacaattttgatcaaatccaaattttttggcagttttatttagaaggctaaatgtgatataattttcacttttaatggttgtgtttaccttatataacagaaaaaaaaaatagcagcttaacaggatagagggttgctttctcacctaaaagacatgcagaggaaagcaatacagatgtggtaggcaatttttcagtgtcatcaaagacccacatcaccatccttctgctcacccctccttaaggtctccttccacatatgtgtgtgtaggtctccttccacatatgtgtgtgtatgtttttgtgtatgcagaaaaatctctagaaacatattcaacaagcttaatggttatattacttctcattagttgcataaggatggaggagaagaggcaagtttatattctccatgataggattctgtggtgtttgaatatcttcatgagaagtatattattattaaagtagcccttaacattttaaaataacaggctgattttaaatatccaaaatcagattgtatggagaattattgtatttaaaagtgtaacttttagatgattttattataatagttttaaatggaaaatatttaaatatttccattttcattttggaagaaaaatggaaatatagatgagaaaaaatacttaatgtcaactttaactctgccatgcagaggtaataattttaaatcttttggaatgttttctcttagacgtttatgtgattatgtgtgtgtatttataaaaacaagattttctgctgctctgcctatggggtagccattcttttattcgtttgctttctttaaaaaaaaaaaaaagattttcttatctatgctgttttataatctcttttccacttactagatcagagacatttttgtgtgacattaaacaattttacatcttgttttttgtttgtttgtttgtttgtttgtttttgagacagtctcactctgttgcctaggctggagtgcaatggtgcgatcacaacccattgcagcctcaacctcccaggctcatgtgatcctctcacctcagcctcccaagtagctgggacctcaggggcaccccattatacccggctaattttttttgtgcagacgagatttcaccatgttgcccagtctggtctcaaattcctgggctcaagcgatccacccgccccagcctcccaaaatgctgggattacagcatgagccattgtgcccagcctacatccattttaatgattgcataatattccatcatataggtatatcagtttattctattggttcctttttcagacatctaggttgtttttgctttttagctattagacaaccatatttcagtgacaaaacaaaaatatatgtacttggatccataatgatttgaattgctctttttcttttctcccattgagatgtgtttctgcaatccatttgtaatgtggattccagatagacacaactgagttcaaatgagagcccataggtgggtagtttggggagagaagaagggacaaataagaggaaatgcagggaggaatatttctgaatgaagtggcttccctgtctcctaactatggcttttcttccttaccagccctttctgggtcctgactgtattcctattcgaaagactagggagggatagataataatttttatttatatttatcctgttttattgtctttattgtatttttaactatttcaatatggatttttttaaaatgtcagcctcccaccataaaaaatggagttctgtgacagcagggaccttgtttgaccagttgacacctgtaaccttagcacctagactagtgaaggccatataagggcctatgggaaatattctgcaagtaaaaaataatcccataaaataattaaaagttgctccaacaacaaagcacttgtcctgttagagggaacttcctattaaaaagacgattttcaaatgtaagcaaaaacagaatagtataacaagtcctcatatcagcagttagcaagttattgccacacttgctttatctattgtttattttcctgaagtatattgtttattttcctgaagtatatatattaaagcaaaatcccagatgtcttgtcattatataattattattccattatcacactttgtaaaattaacaattatttcttagcatcatcttatacccaatccattttcacatttgcccagttgtataaaaaaaatctcattttagacttaatttgttgaaatctggatacatgcaaggtccatccattgcatttgatatgtctcttaagtctaaatacggacatacttgtccccttacttattgaagagcctcgataaattgtcctaagtcccacattctagatttgtctctttgccatttcatgatgccatttaacttgtgtctctatccctctctcccatttcttgtaaactagaggttggttcagaagtttaattagattcaggttatattttatgggaagattcttcgtaggtgccattgtgtaggaatctcactcttgatatttaaactcatgatttaaaaatttaaaaagaggtagttcccaatgtgtagtatttgaagtgtacagattctccctagctttttgaaagttattgaaaatgttttaagactaaaaagagaaataatgaacaaaactagattaaagtcagttgttattgttgtccactgtgtcctgaaccccacccctgccttttattctactcaaatattagacctagtttagataatctatttgtaacatgtgaattcctagatgatttttttcatctattgctgaccacaagagggcatccagtgaacatgttctaagcattcttccattgtcgtcttatgtataatagacataaaactgaggaatcgccttacactcataggtgggaattgaacaatgagaacacttggacacagggtggggaacatcacataccagggccggtcgtgggatggggggacgggggagggatagcattaggagatatacctgatataaatgatgagttaacgggtgcagcacaccaacatggcacatgtatacatatgtaacaaacctgcacgttgtgcacatgtaccctagaacttaaaagtataataaaaaaaaaagaaaaaaaaaactgagctcaaatcagcctgcccttgtttgattgtccaaatcacctatattacgatttttatttaaaacctaatgaattttaaatatacaatctgtatacccaaataaaaggttagaaccaagcatgatatcaaattagcactccagagataactttccagatttaaaggggaaaacctacctttacaatggagatagctggtcatcaccactactttaaccaaatgatcaaacatagtgtcacccagtagcaggacattttgaaattagatgcctcctgaaatatgcaggattacctacagagtgtcttgactgaaaaagaaaagctgaacctgaagctaaccaagcctttagaccttattcccagtgtataggaaatacagggcgagagagaaccaaataaaacagtaccacaattagacaagtccagaatttgctacagttgacagactgtctggtctaatctcatcctaaaaagtcagtgttgtgtaaaaacaagaagttggaaggaccagtctagattaaaagagacatagccaaatgcagtgccggaaaactgttggatggctcatgtaggtattccagtgaaggctaggatgctaataatgaaaaaccatttgaagagtttgagtaaaattgtttcatcaaatgtgagcagaaggcagcagtatagatagaatatatatttcctgaaatgtgattttaaattaaatatatgaaacaaatttatagaatttgattatttcatcaatatacctgaaggttggtatttttaagttggccaaaactttgcttttaatctcattgggcaaaatgaggaattgccttatgataactgtcatcctaaaccagagattttgtttcagatgaacttttattatctcaataatagtgtgttttcctatctgttagataaaaatgggtctgtaactaattggggagtattttttaaagtgtggatgaggaaacccatgttttaaatgggcactagcctcatccactaatgttggcaggaatgttcatcagcagtgacaaagcattttgagatttttgtctttcatcattgtagactatactgtaaaaatcatagtggaaatgatgagagagatgaagaagatgaggaacgagagagtaaaagccgaggaaaagtagaaattgatcagcaacaactaactcagcagcaacttaatggaaactaggtatgaaagttaattatatgggatctgttgtcaggatacaatacacactgatatatacatgttgaagtaatggtatgcagtaagattttttttaatcctattatgtttagttaagagcatgttactaaaatgctgaggattttgtaggcttgcatagtagttgttttttaactagctgattttgtaaccataaaaacaagctatctgctttatcaataagtgtagttgtaatgtcaaatcaataagatattcacactcctcaataacattatattgattgtgttcccctcaagcatcatattttacatttttttatcatcttttaaacaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttca

SEQ ID NO: 993 - DNA, 40544 bp, mus musculus; identical to SEQ ID NO: 142

SEQ ID NO: 994 - DNA, 513 bp, mus musculus; identical to SEQ ID NO: 143

SEQ ID NO: 995 - DNA, 96 bp, mus musculus; identical to SEQ ID NO: 144

SEQ ID NO: 996 - DNA, 2035 bp, mus musculus; identical to SEQ ID NO: 145

SEQ ID NO: 997 - DNA, 2035 bp, mus musculus; identical to SEQ ID NO: 145

SEQ ID NO: 998 - DNA, 1301 bp, mus musculus; identical to SEQ ID NO: 147

SEQ ID NO: 999 - DNA, 1301 bp, mus musculus; identical to SEQ ID NO: 147

SEQ ID NO: 1000 - DNA, 867 bp, mus musculus; identical to SEQ ID NO: 149

SEQ ID NO: 1001 - DNA, 867 bp, mus musculus; identical to SEQ ID NO: 149

SEQ ID NO: 1002 - DNA, 867 bp, mus musculus; identical to SEQ ID NO: 149

SEQ ID NO: 1003 - DNA, 867 bp, mus musculus; identical to SEQ ID NO: 149

SEQ ID NO: 1004 - DNA, 18346 bp, mus musculus
cagttgccggtgagcttgggagaaccgtgggcgctgaggcggtgagtccccgagcggccagagggcgtggccgttccctggggcgcgggcgcgggtagcggggctcctttccgtggccggggccatgctaactgggtgattccagctgtgccccgggcggcgggcgccggaaggagtggtgggcggtgggcccctatccggccagggtccccgccaccactccctgcgacccgaccgggccttcccgggagtccttctgggctgggagctcccctccaggcgtcggggcctcgtcgcccaagagcgaacaggggccgcgcccgagacactagcatccgaatttgaatcagcttttacactttttagggacgtgtcactcttgccgttcctcaagtgctctctttacacacatcgcttttcttataggccccatgagggtggattccctacgagaaggtttggagagaaatcactggtcccacagtgaaatgaacgtttctctgggaagggtccatcgaaggaaacccgaagggtcaattccctggtagacgtggtggaaggttttgggtcagtcagggaagggctgaccagctgtgaggctggcgcagattaacgggtgggtccagagccaaaaacagcacagttcctggatgccctccagcaacggttaggtgcctagactctgggaaatagaggccccctaggaatgactcctgacaagcaataaactttaattgagtgcttcctctgtgccgggcatgctgctattcgcttcgcatgcaattggatccatgcagaacattttataaagtagatgctatgattatcttctgttacaaaagaggcactgggtgtcagggtcacacagctagcaggttattatacctaaaccgatctgctaaagtcgggctaccatcatggtaaagggggatacaaggacagagtgctgatttaggttgactggggaggaagagagtcatgagtactttttttcccttgaatcccctccagagaagaggacaactacagcagctgtctcagcacatgcagagagagaggacccaaggcacatgggcagatacaggtcttgagacctgtagaaacatgtatgtgactgtctctgtgacctcaaagactataccaagaacattttgatgtttttagaccttttgattgctggagaatatagattttgacgtaatcaccatttccctctggcatttaccatgtgaccttagacatgttgttcaatccccctaagcctcaaacctcaattccctcatctgtatccaggggataatactagtacccagctcctaaccttgggtgagggttaactgacaagtatatgtagaatgcttagaacagtacctggcacatagcatgaactcaataaatatccgttgttgtgaatgcatagcaaattcctaatggcctccctattgcagtgtatttttcacataggagatcctcttggaatgctatggtggaggggagtggggaaggaatggcatggggttactgggggaattacgcagactcggtgaggacaagaatgagagatggacaatttgctgcctttgcaaaccatggctctacctaagttcactttggtcgaaggccattaggagatacttaaagctagatggactttcagagttttttggaagtattgttagtattccttcgccatttcttttgagatctacatatattcagaaacacatgacaattggaattaaactgggaatgggttaaatgcaaagagatctataagggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcatttaacaaactctgggagctttgctgtcaatggctgaagccaaagatgcgctctaaggaacaaatcctggagctgctagtgttggagcaattcctaactatcctgcccacagagatagagacctgggtgagggagcactgcccagagaatagagaaagagttgtgtcactgatagaagacttacagagagaacttgagataccagagcagcaggtaagaaaagaatgtgggatctttgtgattggtccaaaggaagtagctgaggcagctgggactagaccacacatttgtctctatgtcattccccagcctcaagatttctccagagtcctcttcctttttctcttctgctgaactcagcaaatgagtcagtgcttttaactctatcagactcaattccccttctataacaaatagtttataatgtccactttactatgcacaaatgaaattgatagacaacataatctacccacatacatcaacccaaagcatcagtaaattgctccatggcctgaaggccaattctagccataccctgtttatctgtatactctgtatgtaatggtttttttatcttgttgaaaggtcattgaaaaaaagaggaaggagaagaactgacagtgaatgtgccccacagtgcctaaaatatttactatttggctctttataaagtttgccaaccctgaatcaagtctagaaggaatataaaggaaaagaaacatagtttgttataaattgatagggatttgtacatatatgtgcttgggcctgaccgaatgtcatgaagttgtcagatgtttgcatctatgcttagaatcattgtgaatgggacagccagaaattcagactgataaagctcaagtactacgaacagtgttgctcctcgtcatgtgattttccaaaatggcatacgactctaggtaaatctgaacaataagcagtgtagtctttgcttttcacattagtgcattcctagaaaatttcatttgtgctgaaactatgcaaaacaaaacaaacaattgtacttatttgaccaacaaggtggggttcttgacaggttctttttactcacatgaatgtttgagtgggacattccacacttggtagggacctagaacaattctgcattgtaaattatgttccattaaattctgatagccaccacctgtcagcatatccaaaactccccatggggacagtggcactgtctgccattcagaatgactgtgtaaagcctcttttcagaagtgccgtgactgagagagggcagtatctttgggaaaagggagcaggagcttccagatgggcatcagggatactccagtcttgtctatgggggttctctgcaggagctgttagcttcagggctcctgaacaggagtcttctgaagttttctgtctccctagggtacttgggttggtggttgcccttcctttctctgtctccttggttttgtttactatataagattttatcttcatgtggtctagacatttgctgctgaatacagtcactactagtcatgtacagctcttgagcccttgaaatatggccaatacaaattgagatctgctgtaagtatgaaatacacaccacatgcagaagacttggtatgaaaaaagtaggtgaaatatctcactaataattgttcatattgattacatgttgaaatcctgattgtttgcactggattaagtaacacgtactattaagattggccttactttttaaaaaatttattcatatggccactagaaaatttaaaattacatgcatgattctcatacaattctactgggcactgttggtctagacttgagagtgatggttctggcatttcccccaggttgatatgcatgacatgctcttggaagaactggcaccagtgggaacggcacacataccaccaaccatgcacctagagtcacctgcactccaggtaatgggacctgcccaggaggccccagtagcagaggcatggatcccacaggcagggccaccggagctgaactatggtgctactggagaatgtcagaactttctggaccctggtaaggcaagggtttctctcctttcttttgtttctgttttgagagttcaggaactctcaagggttggggttgggttagaaacaccaattactcaatggaaattgaccactcagataaagaagaggaaaaagtctctctgggaatagtagggaacaaagcactttggatagaaccctgggattaggaaccctttaagctaatgaccctgataaggagtcttttgatcaagaatgttacacaggaaaactatgggagtttggattctggataaggactcatttctcagcccaattttaatcaacaggaactgtgatgtggtgggccccaagggcctcggttgcttttatggcatcagagccttattcaaacttaatactttagtaatatagtctatttagatcctgtaagatcaaccacttactgcagtctaaaggaaatatctacctcattaaatcaaaacctattacagtgtttttcaaactgtagtaagcagaccatttgcagcatgaacaccacaggtgcatgtttagcaagctctgcaggtgagtgctacacacactaaagtttgagaatcactggcccagacaccacagggattagttctagaaggagaaagtccaagtggagaaaggcagcacgatcacatagtccagttgctcctatattttattcccctttggggttttctattttttttttttttttttctgagacgggagtcctgctctgtcgcccaggctggagtgcagtggcgcaatctcggcgcactgtaacctccacctcccaggttcaagtgattctcctgcctcagcctctcaagtagctgggatcacaggcatgcactaccacacgtagagacggggtttcaccatgttggccaggcaggtctttaactcctgacctcaggtgatccgcctgccttggcctctcaaagtgctgggattacaggcgtgagccattacacccggcttctcctttggggttttcttacccagtgttccctgtacctcttctacccctcacattaaagctttggcccgagtgtggccagaatcctctccccgactcccccaggtactgtttcaacatgttcgcacgttcaagagactgttaaatactgagaccacagaagacacataaaaaatgaaaataagaactgtccaagttataaaatataaatgtctgatccatccataactagctcagtacccaggattaggaaccatgcccctttccacatcatattaatatcatttattcatttgtacactatctacgagcacctttgaggagccagacaccatgccagaccctggggattcagtagcacacaaggttggaaagcagctctggtcatcttggagattacagttcagtggacaattcagatatgttagtaggacgttttgtcctgtatgtaacagaaatctgacagtaaatggtatgttgggaggaataggatgcccaggagcatggaggagggccacctaaccagcttttggctgagagggaagtctggaggaaggaggatctgggttaaaacctacaggatggatcaaagtgagcctgtggagtggtgtacatgggaagcggagagggctgggatcaaaagcaacaacatgtgcaacgttctgaaggcagagagaagacctcctgctgcagtgcaagggacatagaagagcagtggggcaggagtggcaatagaagaggctggagagagaagcagggtcctgggtcacgaagaacttgcagcctcatggagaagtcacacttgattatcagggaagtggggaaccattttgaggttctccagtaccagaatgatacacacaaatttgcattttaggagattattctggctatagtaggaatggatacatactactgaaagcagggaccccatttgggaggttgttgccatcattcaggtgagaagatgttgttctagagcaagggcatgttggtgatgatggagtgaaaatgtaattcaaaagatacttagcaggtgtgaaatatagagcttggtgattgggtgtcagggtgatggagaagaagggagtaaggatggaatccaggtttctggccattgaactgggtagatggtaatgttattcactgacatgacaaacaaaagaggaagatcagattcggtgggtcaagttgagtttagatttgaacatacagagtttgaggtgcttatgggtctccagcatatttttaaataaaagtgacaaaagaggaaaactttacaagtatgcatattgtggtcaaagcagaactatatattgccatttatgttccaagctttacatcatctacatttcatagtctattgaggaattctaaaaaaaaaaaaaaaaaaaaaaaaaaacaaaaccgggtttatgtgtatatgcctggaacaagtagtaaaacttagctagtaatattttgaagtataactctttctgcatttgcattctgattctccatgttaattcgctccttttgtcaacactgcaggtacaaataccacatagtagcaatatttatctggtgttaatattttgctctctaaagcacatggaaatctagtatatttaacaaaggataggtagaattaattaatttaacagataaaaattacaaattggaggacaggaaattatccttttcttatcaccgtttaaagtgatatattatgctttgaaaaatgttgcaaggcttattttattatttaaaggttacttaaacttttactttaaacaaaagtatatttgatgtattacatgaaatacattctattgtggactgaatggaaagcacaagatgccagctgagtggaaaagaaattcaaaagtaatggaagaagtcaattgattttatattaatgtttggaacctatttcctatgagcaaaaaattaggttgttgagtatatatgaattgtgcatatatattttttcatgtaatataactgaaaacacatatacacattcattgcaaaataaaagagaacttaagtgaacaatataaagtgacctaaggaagacataaactttaaaacaaaatcccttatttgaattcatgctggacactttgatgccagagataggcaataatattagaatgtatgcaatcagaaagaaaagaggcaaggagacgctagtcttaaaaacataaaatatatcatgcttatctttgaaaatatggagttcaaaattcgtacaccaaaactggattgcattttgagttgtcaaagctttgggtttttcatttcaattgatgaggtttcatttggaatgtgtgtgaaatgtaaaagatcacatctttttggtgatgaagaatatgagagatgaaaatttaaagtaaaatacaggacaaacaaatgctgtctagaaagcatcagaagattcttataacttaaacttcttcagattattctactataccaaaaaatttaccataagctaatatctaacccccaactatagtaatgacatttcttggtgtagtgaagctcttacgagacagtctttgctaatggggtttaatgaagccattccctgagtttaggatggggggaacattcaatgaagcaccttctttgttaatctccaattgcttttccctctttgcatgggatagctattgaagggcaattaattatccccgaaacttagcagcttaaaggaaaaagtatttatcatgttactatttttgagaggaattcaggagtgatctactagatgtttatggctcagagtctctcttgtagttgttgtgaagatgtcatcagggactggcaggatgcctcaattccttgccaaaggaatttctccataggttacctaagtatctttatgatggggcagcaggcttcccccagagcaaaggatccaagagaaagcaaggaggatgacacaatgtctttgataacctacctacataccatacttataccatattctgttcattagaagagtcactaagtccaacccacacttaagtgaaggaaaaggaagttccacctcttgaaggaaagaataccgaagaatttgggagcgtattttgaatcaaccatgcctggacttaatagccttttacttaaaaaaaaaatcaaaaataatttcctttttttttcttcagttaatttttcctaagtaaaatttcttcacttaatttggtcaaatataatatacctatgatggatctcttagctatagccagaggatgagtttaacatcctgggcaatatgttattgtcactggaaaactaatattctagactatggtctcaaaaccaggagagatgattaaatttaaggtaacaggctttggtttctatctgtagggccctccttttttccttttatttttaattgacatgtaataattgtacctatttatgggatacagagtgatattttgatatgtgtgtacaatgtgtaatgatcaaatgagggtaattagcatatctgtcaccttaaacatttatcatttctttgtgtttctcattcctgtgggagctaaaaaagaaaatgagctcacagaagtagagtgtagggcccttctctttttactgaccagcagttaatgtttcttctattactgtaaaaccactcatccaataatagttgctttacagatagcttacattgagggtaaagaaaagagctccttgacagaagtaggcattaaggcctgcttttttattgccactcaacattgacccagaagccatggagccaaactagaaaacatttggagaatacttatatatgcgggtattgatatgataaatttctagaattggaattgattgattaatgggcatttaaaactttaatagatattgtcaaattgacttctgaaattattgtaccaatttatcctcccaccacaatatataggaatgccaaattctgctcatcttcacttatctttgctatgtaagagccataactgttctcgctatgttggccaacagagtagggcaaatatctgtggaaaccctttcagtaagtgtcagttttattcagcattggtggtggtattttattcaatatataagagtagaggatgggaactgatacctaaaggtgagacatgggtcaaaagtgaatgggaattggttttagctgacatggactgtgaaaataaggttgagaaatgcaaataaattggtgacagtgtccagaagtatctgaatattactcaggaccacagggttgtggtgggctgtgctacacatataagaagtgcattaggttggcatccatgaagaagctcaactatgagcaccatgttctcacatccaaggtgtagagactgtcctgatgcacccaatttggggccaagctttttgaaagctggcaccaggagtatgatgctggggacaaggaaccaaagcaaaagtactcaaacctctgtaatttggtgctgtacataaggtagcagctagacttgagggccaatatgggaagcccatgagacacagctgcctggtagtaacacttctgaccttagatctcatgggtaccagattctgcttccagggctacttttagtccttcagctaggtcgtagagcttcttttacccaaggagcaggtgtctgggcctggttttgaagtgatatttgattaaatctataaccttaagagtttcaaatctgtgctctgtaagatgagaatagccatatgaacaattcctgtcattcccaaaactgtttttctggctttcatattgagatctcctgggcctccaggcttctaccaccctaagcctttgctacttgctgctctccccagtttcaattccttctcacttctgcttgatggcagctttctttaatctatgaactccagtttatttttttccactaacttttaaaaattttttttttaatttttgtgggtacatagtaggtgtatatatttatgaggtatatgaaatattttaatacattgcatgcattgcataataatcacatcatggtaaatggggtatccatctcctcaagtatttatcctttgtgttacaaacaatccaattctactcttagttattttttaaatgtataatttctgtttttttgggggggcctcttccaccacatcattcagttatcccactcctgggtttaaaccaagctttgttaacaaaatagtgagtttataaaacattttattggaagtgtattttatatttcttaatctaaaatctattgtttttttccctgtgaaaatgtaaaataaagtattttacaccacttcctaggatttgatataatgtactgaaatctaaattttacttcagattaatgttagccaaactaatttgttaatatcatttaatgatgtcaatatttaaattttttttacatttacatctttttaaaatagcgttattgaaatataattcacataccatacattgtcacccctttgaagtgtacaatttaatgttttttggtatattcacaatatgtacaactgtcaccaccctgtaccctttagctatcactttttggcccccatctctcccactccaaagcaaccactaatttactttttgtctctgtagatttgccaattctggatatttcatataaatggaatcatacaatatgtggccttttatgactagcttctttcacttagcatattttcaaggatcaactatgttgtaacatgtatcagtactttattcctatttatggttgcatagtccattgtgacattataccacattttgtttattcattcaacagctgatgaacatttagattgtttttatattttggctattatgaatgatgctgctataaaaatttcagtatgacattttgtatttatgtatgttttcatttttcttgggtatatacctaggagcacaattgctatgtcatatggtaactctatgtttaaacttctcaggaacttctagactgttttacaaactgattgcactcttttacattccgaccagcagtgtacaagcactcttatttcttcacatcctaggcgacatttattattattatttgacatttttattctagccatcctataggtatgaaatagtgactcattgtggttttgatttgcatttctttctttgaagagtaacgatgctgaacatgctttcatgtgcttattggtcatttgtatattttcatagacctatttagtccccttgcccatttttaattgaattatttgtctttttattattgaattgtatgtgttcttcatacaggtgacccttgagcaatgtggaggttaagggtgctgacctattgtgcagttggaaatccatatacataacttttgtttctcccaaatttaactactaatagcctactgttgactagaagccttactgataacatcaatggtcaatgaacacatatttcatatgttatatttgttatatattgtattcttacaataagtaagctagagaaaagaaaatgttattaagaaaatcataaggcagagaatatatttattattcattaagtggaagtggatcattataaaggtctttatagcaacacaaatgaactaagacagtgtggtacttccataagaatagacatgtagatcaacagaatagaggagagtttagtcttgctgtctcagggctgtcagaggtggaaggaaatctgcctgtaagtgtatttgtgtagttcaaacccatgttgttcaatggtcaactgtgtattctagataaaagtcccttattagacatatgatttgccggtattttctcccgttctgtaggccatcttttcactttcttgatagtgtcctttgtagcccaaaatatttttttaattttgatgaagtcatatgtaattgttttttcttttgttgtttgtgcttttgatgtcttatctaagaaataattgcctaatccaaggtcacaaaaattttctcctgtgttttcatcgaacagttttataattttagctcttacatctaagactttgatctatttttcattaatttttaatagggtgggaggtagaggtccaaataataattttttcccgtggagacatccaggtgtctcagcattatttgttgaaaaggctattctttttatattgaatatccttgaaacccttttcaaaatcagttgaccacaggacaggtatatggatttattgctagattctcatttctattctgttatgtttagttggtttatagtattttctatgtcttgtattattgatcttctgcctagattttctgtctattagtgcaaggagttattgaagtgtccaactactattgttaaattatctggttcttgtactatttctgttgagttttgttttatatattttagtactcagaaattaagtgcatacatgattataattgttatatcttcctgatggattgatatttttatcattataaaatgatcctgtatatcttagtaacaggggtttttttgtttgttttaatgcctattttgactggctctcttgtggttgctacttgtatgatatatctttttccatccctttacattcaatcggtttgtatctttgaatctaaagtatacctcttataaacagtatatagttggatcttttcaatccagtcagaccttctctgctttctgattaagtcatttaatgtatttacatttaatttcatttgtgatatggttggatttatatctgccattttgctttctgttttctatatgcctcaagtcttttttgttcttctatccctcttttactgctttctttttcattaagtaaatatttctcatgtaatattttacttactttaataattttactacttttatttctttagtggttgctctaggatttaccatgtacatcttatcattggtttcaaagttatactaacttaatgccagtgagatatagaaatgtttctcctatgtagctctgttctcttttccccctttttgtgatattactattatacatgttacatcaaaaatgttttaaacccaagaatacattgttataattattgctttatataattttaagactcttaagaagctgaaagaagaaaggaaaatacatatatattataacttttgttatattagcattgtttatcatttctggttttcttcatttgttcctgtggatttgaattaccaactggagtcatttcttcagtcccatacactttgctcttacccacctcatttctgctgttattgggaaatatattacatttctatatgttgtatgcccagcaatacactatatacatatttttatacagttgccttttacatcttttaacaaaagaaagaagcaatactgtcttttctcattacgtaattatttttacttgtgctgctttgtcatgtggattcaaattaccattcatttagattataagtcagtattttgtacctaagcctttgctattctctcctattccaagtttcaattgaaactccatcttttacttcacagcagctttcttttgatctattaccttgaattttatttgacctgtttcatattaccctgtaatttcactcttagctttgaaatccaaatgaaaacaaaatagtgaatttaaacagcacttttatttgaaattcagctttagtttcttaatcttaaaaaggaaatttttttttcatgaaaaactaaaacaaggtattttagcccacttcctctgccttgaatataatgttctggaatttaaattttacgtcagattaacattagtcaaactaaattcctaatgtcattttaataatactaatatttaaacatcagcctacatttagatatcaaattagtaatttacagcccacatttcattgaagaccagtaaacttgatcagagataaaggaggagaataaggggctcagaaaagaggatgtaagcaacaccagctgtcaatgaggagaggggtggtcagacaaggcgagagtgagtggttggaaacttcacctggttgtccttagattgacactttgaaatactattttgtagtcattttgggttatagtcattttcacctgtataagttatctgggctaattttaagagaatccacttttagacttcagcggaaaccaacataaatgctgcttttgctaggttcaacccagttcaattttcgtttaaattcaaaagactccactgaaatttttccagtaaacactttactactttcacctctctttcttcatttggcactcaatagcagtgtttcccagtattaatatggcaaaactttatgaaatttactttatattttagctctaacctaaacaaatctagtatcaaaatagatgctgaaatgatttagtgcattgatttcagcacagaatttattcactcaccttccatagattagagaatagctttgaattgaacaccacctcattttcattttgctcttatcttttaaagaaaagactgttgtaagagactcaggtgaagtaatagtaatggagaaggaagtagatactaagaggctatctgtccaagaaatcagcctaaattttggaaaaacctttgatgagccaaactgtaatgcttcccatctttcttctggccaggatatccattaccaaaacttgacatgaacttctcattggagaatagagaagagccatgggtgaaggaattacaggattctaaagaaatgaaacaattacttgattccaagataggtaagtaattgttctttgatatactagtgggaaaaaaaaagaaaaatttaacctaaataaagagtttggaattctatttaggaatttctatgttcctgccactggtttaacataactcttcattttccttcactttcttttctccatggaacacaatatcatctgcagtttctatttcttctctcaggttttgagatcgggatagaaaatgaagaagatacttcaaaacagaaaaaaatggagactatgtatccatttattgtaactttagaggggaatgctctccagggtcccattttgcaaaaagactatgtacagttagaaaatcaatgggaaacccccccagaggatttacagacagatttagcaaaactggtagatcagcagaaccccactctgggagagacacctgagaactccaacttggaagaacctctcaaccctaaaccccacaagaaaaagagtccaggagagaaacctcaccgatgtcctcagtgtggaaaatgttttgctcggaagtcacaacttactgggcatcagagaattcattcaggagaagaacctcacaaatgccctgaatgtgggaaaagattccttcgtagttcagacctttatagacaccaacgacttcatacaggggagagaccctatgaatgcactgtatgtaaaaagcgattcactcggcggtcacatcttatagggcaccagagaacccattctgaagaagaaacatataaatgtcttgagtgtgggaaaagtttttgtcatggatcaagtcttaaaagacatctgaaaactcatacaggtgaaaaacctcatagatgtcataattgtgggaaaagttttagtcgactgacagctcttactttgcaccagagaacgcatactgaagagagaccttttaaatgtaattattgtgggaaaagttttagacagagaccaagcctcgttattcatttaagaatccacacaggggagaagccatacaagtgtactcattgttctaaaagcttcagacagagagccggccttattatgcaccaggtcactcactttagaggacttatttaagaattgctaagggaaacaggtcttacacaaattgacactaactcaaaaaaaatcttaacctgcagcaggctgtttgtcttggaagcttttgtttgagcttataagaacatagacagcttttttttttactagttttaaaacccatcttccaaggtatatgaattctagagtatttatctactcctgtgattttcttagatttgatttcttctgtctgcacaactcttctttttttaattacaatgaaaaattttgtgttccaaggcaactgtatcataggtgtaaacataaagcatataaattatgacaatccttttagaggtagggtcaatatagtggataaacctgtctatcagacgtattgattatagcagtactatagttattctgctgtcattattaaagatgattatattcattcaaagctttagatgtgtcccatgtggcaagaaaggagacagtgaattttgtcaaacaataaaaatgtgtcaggaacacaaggatgaaggggatgtcatttgcctggtaagaactgggttatttccactgaaatttgttatgtttaaggaaattaagattttaagcttgaaattatacaagcagaatctaatttaattttgattgactgaagaaccagggtcttttgctctcctttggtatttcactctcctttggtattcaatcatgtgtcttttagtgctttttaaaattttacccattctttaattcagcatctccctatgtatgtgtcatagaatacttagttctgctagatattctgcaaatatatttgggaattacttcctgctgtttcgccttcttaggttcatagtacacatcagcatatgagaatctctgagaggtcctctagaaaggagagaaaaagcacctcttttggctcaatgttttccaaacttatttgaccccaaaacctttttcatatacccaataataagctacagaactaatattctgcaaatgtctcttggaacacactgccttaaacagatatttctatagctgtcagtatagttatgttgctcccaagcctagttatctccagttgttttaagggtgttatgaaaaattcttaaaatatatatgaatttgtgtaacacacacagagacacacacacatactactttaagggggtgaggatcattaattcagataatttttaagtttcctagtgattctcaatctctttgaattttacttacatttacacacacacgcacacacatatgtatatacacatatcattttaagaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatg
